United States Patent 11,931,406 (FLAVIVIRUS VACCINE) - sequence listing, part 9

SEQ ID NO: 5877 - RNA, 9879 nt, Artificial Sequence
  derived and/or modified CDS sequence (wt) from DENV-1__JF937597__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagccaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucauggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccauggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccguagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugccguugaaccagggaaaaaccccaaaaauguacaaacggcgccgggcaccuuuaagaccccugaaggcgaaguuggagccauagcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacagaaaaccaacauaugaaagagacguggaccuaggcacuggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucaauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5878 - RNA, 9879 nt, Artificial Sequence
  derived and/or modified CDS sequence (wt) from DENV-1__GQ868609__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacguggugcuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccaacaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacucaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucucuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugagauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagauccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaaaagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcuaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaauuagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5879 - RNA, 9879 nt, Artificial Sequence
  derived and/or modified CDS sequence (wt) from DENV-1__GQ199803__SS-prME
ucugugaccaugcuccuuaugcugaugccuacagccuuggcguuccauuugaccauacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacucagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagaucaaauacgaaggaacagaugcaccaugcaagauccccuuuucgacccaagaugagaaaggaguaacccagaaugggagauuaauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagguuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaguuccuuggaggagcugggggauggacuugcaaugggcauuaugauuuuaaaauuguugacugacuuucaaucacaucagcugugggcuaccuugcuguccuugacauuuaucaaaacagcauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugauggcaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggcgaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucucugaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagacagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguagcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5880 - RNA, 9879 nt, Artificial Sequence
  derived and/or modified CDS sequence (wt) from DENV-1__GQ199804__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacagaagucacaaacccugccguccugcgcaaacugugcauugaagcuaaaauaucaaacaccaccaccgacucaagauguccaacacaaggagacgccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaagugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuucuuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgcgauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacauccggaucucccaucgugaacagagaaggaaaaauaguaggucuuuauggaaauggaguagugacaacaaguggaaccuacgucagugccauagcccaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggagaagcaaggaaaacguuuguggagcucaugagaagaggagaucuaccugucuggcuauccuacaaaguugccucagaaggcuuccaguacucugacagaagauggugcuuugacggugaaaggaacaaccagguguuggaggagaacauggacguagagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcucugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccggagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacgugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5881 - RNA, 9879 nt, Artificial Sequence
  derived and/or modified CDS sequence (wt) from DENV-1__GQ199805__SS-prME
ucugugacuaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaggggauuauuuucauuuuguuaaugcuaguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguucugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacuaaacuggaaggaaagauaguucaauaugaaaacuugaaauauucaguaauagucaccguccacacuggagaccagcaccaggugggaaaugaaagcacagaacaugggacaacugcaacuauaacaccccaagcucccacgucggaaauacaguugaccgacuacggagcucucacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagacuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagaucuuuggaaccgcauauggaguuuuguucagcgguguuuccuggaccaugaaaauaggauuagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugagguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauuuacagugguuguaggagauguaguugggaucuuggcucaagggaaaaaaaugaucaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacucccacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaauuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucgauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaccagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuagccauguuucuuauagcagaaaacaaaaucuggggaaggaaaaguuggccccucaaugaaggaauuauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaacauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacuuauguaccaagggaagagacuagaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuuuaugacagccacucccccaggaucgguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgcgucauucuagcaggaccgaugccaguaacuguagccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggaucaucccagcccucuucgagccagagagggaaaagagugcagcaauagacggggaauacagacugcggggugaagcaaggaagacguuuguggagcucaugagaagaggagaucugccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagugucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcugugcugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacagcuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaauccuuacaugccaagugugguggaaacucuggagcaaaugcaaagaaaacauggaggaaugcuagugcgaaauccacucucaagaaauucuacucaugaaauguauuggguuucauguggaacaggaaacauugugucagcaguaaacaugacaucuagaauguuacuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguagugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaccacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccagaauuacugacaucauggagcccgaacaugcccuacuggcuacgucaaucuuuaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugaaggaaucuuuuuacccagcgaauuggagacccaaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggcuuccaacauacaaguggccauaaaccaagugagaagacuaauugggaaugagaauuaucuagauuacaugacaucaaugaagagauucaagaacgagggugaucccgaaggggcacucugguga

SEQ ID NO: 5882 - RNA, 9879 nt, Artificial Sequence
  derived and/or modified CDS sequence (wt) from DENV-1__GQ199806__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccauccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacaugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaagcagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauuguaguuggccuaguaacauuguaccuaggaguuaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccacuuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaagugcuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugcuucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaugggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuucugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcguauguggugauagguuuguuauucaugauacugacaguagcagccaaugagaugggacugcuggaaaccacaaagaaagauuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccuaacagccauugcaaaccaggcggcuauauugaugggacuugacaaaggauggccaauaucaaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugaacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaauaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuaugguuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcccugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguugggaagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagcgauccugaaggggcacucugguga

SEQ ID NO: 5883 - RNA, 9879 nt, Artificial Sequence
  derived and/or modified CDS sequence (wt) from DENV-1__GQ199809__SS-prME
ucugugaccaugcugcucaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguagauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggcuaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagucacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacacaaccuucaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccgguuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggagagugaaaugguaauuccaaaaaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaacgaugugccgcuagcugggccacuaauagcuggaggcaugcuaauagcauguuauguuauaucuggaagcucagcugacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaggaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagguccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacucgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggauguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggacccggacaugaggaaccaaucccaauggcgaccuauggauggaaccuaguaaaacugcacuccgggaaagacguauucuuuacaccaccugagaaaugugacacacuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaauuuguacaagagaggaguucacaaggaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuaccgacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaacuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaaugagggugaucccgaaggggcacucugguga

SEQ ID NO: 5884 - RNA, 9879 nt, Artificial Sequence
  derived and/or modified CDS sequence (wt) from DENV-1__GQ199810__SS-prME
ucugugaccaugcuccuuaugcugaugccuacagcuuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaagcagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccugucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaaguagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagacuugaucucauauggaggagguuggaggcuucaaggauccuggaacacaggagaagaagugcaggugauugcuguugaaccagggaaaaaccccaaaaacguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccucuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaaaucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagauagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacaacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggggcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5885 - RNA, 9879 nt, Artificial Sequence
  derived and/or modified CDS sequence (wt) from DENV-1__GQ199811__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguccaauaugaaaacuugaaauauucaguaauagucaccguccacacaggagaccagcaccaggugggaaaugaaagcacagaacaugggacaacugcaacuauaacaccucaagcuccuucgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggggcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaacuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucuugagaacaucauguggaagcaaauaucaaaugaacugaacuacaucuuacuugaaaaugacaugaaacucacagugguuguaggagauguugcuggaaucuuggcucaagggaaaaaaaugauuaggccacaacccauggaguacaaauacucguggaaaagcuggggaaaagcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccuugacauuugucagaacaacguuuucccugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaguauagacugcggggugaagcaagaaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaacgccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccauuauacuggaguucuuccugauggugcugcuuauuccagagccagacagacaacgcacuccgcaggacaaccagcuggcauauguggugauagguuuauuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagcuauugcaaaccaggcggcuauauugaugggacuugacaaaggauggccaauaucgaagauggauauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaucuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgcgcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuuuaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagagacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5886 - RNA, 9879 nt, Artificial Sequence
  derived and/or modified CDS sequence (wt) from DENV-1__FJ882549__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaacaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguucguggacagaggcuggggcaauggcugugggcucuucggaaaaggaagccugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguuuuagugcagauuaaauacgaaggaacagaugcaccaugcaagaucccuuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggcgaaaaagcuuugaaacuaagcugguucaagaaaggaagcagcauagggaaaauguuugaggcaacugccagaggagcacgaaggauggccauauugggagauaccgcaugggacuuugguucuauaggaggaguguucacgucuguuggaaaacuaguacaccagauuuuuggaacugcauauggaguuuuguucagcgguguuuccuggaccaugaagauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagcuaacgcuuccgacaggauggggaugggaacgacguaucuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuaauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucauuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaagaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggcugacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaagucgccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauacuagaaauagggaaacuuccacaacacuugacgcaaagggcccagaaugcuuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaagggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauuuaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagauguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacaccacacccuuuggacaacagagggugcuuaaagagaaaguugacacacgcacaccaaaagcaaaacggggcacugcacaaaucauggaggugacagccaagugguuauggggcuuucuuuccagaaacaaaaaaccaagaauuuguacaagagaggaguucacaagaaaaguuaggucaaacgcagccauuggggcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagcuggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuuauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagcuuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugauccugaaggggcacucugguga

SEQ ID NO: 5887 - RNA, 9879 nt, Artificial Sequence
  derived and/or modified CDS sequence (wt) from DENV-1__GQ199814__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccugauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucucacauuggauuguucaccuagaacaggacuagacuuuaaugaaaugguguuguugacaaugaaagaaaaaucauggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggauaagcugacucuaaaggggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagacaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguuuacgucuguuggaaaauuaguacaccagauuuuuggaacugcauauggaguuuuguucagcgguguuuccuggacuaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaccgaagaggugaugagauccagauggaguagaaaaaugcugaugacuggaacacuggcuguguucuuccuucucauaaugggacaacugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaagugcuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacaaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccguuagcugggccacuaauagcuggaggcaugcuaauagcauguuauguuauauccggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaggaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacgacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagaguaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccauaauaaggaaggugaucaguacgucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaauuugguuauguugcacaacuccgaacaaggaggaagagccuauagacacgcaauggaggaauugccagacaccauagaaacguugaugcuccuagcuuugauagcuguguuaacugguggagugacgcuguucuuccuaucaggaagaggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcagcgguauugaugcuaguggcucauuacgccauaauuggaccuggacugcaagcaaaagcuacuagagaagcucaaaaaaggacagcagccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaauauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugagaugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuaguacgaaauccacuuucaagaaauucuacucaugaaauguauuggguuucauguggaacaggaaacauugugucagcaguaaauaugacauccagaauguugcuaaaucgauucacaauggcucacaggaaaccaacguacgaaagagacguggaccuaggcgccggaacaagacauguggcaguggaaccugagguagcuaaccuagauaucauuggccagaggauagagaacauaaaacaugaacauaagucaacauggcauuaugaugaggacaauccauacaaaacaugggccuaccauggaucauaugaggucaagccaucaggaucagccucauccaugguuaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaagaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5888 - RNA, 9879 nt, Artificial Sequence
  derived and/or modified CDS sequence (wt) from DENV-1__GQ199816__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuuaggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacgagaaccgaaacguggauguccucugaaggcgcuuggaaacagauacaaaaaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaagcauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauaccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaucagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucauggaaaagcuggggaaaggcuaaaaucauaggggcagaugugcagaaugccaccuucaucaucgacggcccaaacaccccagaaugcccugaugaccaaagagcauggaauauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaauacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcauuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccugaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuucugucucccgugagaguucccaauuacaacaugauuaucauggaugaagcacauuucaccgauccauccagcauagcggccagaggguacaucucaacccgaguggguaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaauaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucagggaggggccuagggaaaacaucuaucggccuacucugugugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauuuaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugauacaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcggucuccauggcaaacauuuuuagaggaaguuaucuagcaggagcaggucuggccuucucauuaaugaaaucucuaggaggagguaggagagguacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaguuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagauugauccugaaggggcacucugguga

SEQ ID NO: 5889 - RNA, 9879 nt, Artificial Sequence
  derived and/or modified CDS sequence (wt) from DENV-1__GQ199817__SS-prME
ucugugaccaugcuccuuaugcugaugcccacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggaaacuugggcccugagacacccaggauucacggugauagcccuuuuucuagcacaugccauaggaacauccauuacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacuuuugaagacggaagucacaaacccugccguccugcguaaacugugcauugaagccaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucauccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagccgggccgcuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuuguguggugcuuuuggcagaaaaagaaacagagaucuggaguguuaugggacacaccuagcccuccagaaguggaaagagcaguucuugaugaugguaucuauagaauuaugcagagaggacuguugggcaggucccaaguugggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuaugucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguuccucuuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagccucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggucaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagaaggacugaaaagaggagaaacaaccaaacaugcagugucgagaggaacagcuaaacugaggugguuuguggagaggaaucuugugaaaccagaagggaaagucauagaccucgguuguggaagagguggcuggucauacuacugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggugccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccgugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaaccagaacaugcccuacuggcuaagucaaucuucaagcuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5890 - RNA, 9879 nt, Artificial Sequence
  derived and/or modified CDS sequence (wt) from DENV-1__FJ882550__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccaaaaggggaucauuuucauuuuguuaaugcugguaacaccauccauggccaugcgaugcgugggaauaggcagcagggacuucguggaaggacugucaggagcaacuuggguagacguaguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucaugguuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaaugacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuaucaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaaggagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucguuacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuucuaauggugcugcuuauuccagagccagacaggcaacgcacuccgcaggacaaucagcuggcguauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagauuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaccaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcacuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5891 - RNA, 9879 nt, Artificial Sequence
  derived and/or modified CDS sequence (wt) from DENV-1__FJ882551__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaacgccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacaugggaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggauuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucguauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacauuauaccuaggagucaugguucaagcggauucaggauguguaauuaauuggaaagguagagaacucaaauguggaaguggcauuuuugucacuaaugaaguucacacuuggacagagcaauacaaauuucaagcugacucuccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaagcuggggaaaagcuaaaaucauaggggcagaugugcagaacaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaacaucucagcauaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaagaugggugcugguaugguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaauaggacaauugacauggaaugaucugaucagacuaugcaucaugguuggagcuaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcauguuaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgucuccugucucccgugagaguucccaauuacaacaugauuaucauggaugaagcacauuucaccgauccauccagcauagcggccagaggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuaucccacaaaguugccucagaaggcuuucaguauucugacagaagauggugcuuugacggggaaaggaacaaccagguguuggaggagaacauggacguggagaucuggacaaaagaaggagaaagaaagaaacuaagaccccgcuggcuggaugcuagaacuuacucagacccacuggcccugcgcgaguuuaaagaguuugcagcaggaagaagaagcgucucaggcgaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggcuacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuauugauacuaugcacaucacaaauccucuugaugcggacuacaugggccuugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagucucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaagaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcugaaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaauuaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5892 - RNA, 9879 nt, Artificial Sequence
  derived and/or modified CDS sequence (wt) from DENV-1__FJ882552__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaaggaauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauacucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuucaaugaaaugguguuguugacaaugaaagaaaaaucauggcugguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuguuccgcagacuaacauccagagaaguacuccuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucaaaacaacgucuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguagagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagcgccauagcucaagccaaagcaucacaagaagggccucuaccagagauugaagacgagguguuuaggaaaagaaacuugacaauaauggaccuacauccaggaucggggaaaacaagaagauaucuuccagccauaguccgugaggccauaaaaaggaagcugcgcacauuaauucuggcucccacaagaguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguauaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacguacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuagggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaucacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaagugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaagccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaacuagagaccccaaauuuagccaggagaguucuugacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccaguugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggugcacucugguga

SEQ ID NO: 5893 - RNA, 9879 nt, Artificial Sequence
  derived and/or modified CDS sequence (wt) from DENV-1__FJ882553__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacauuguaauaggagcaggugaaaaagcuuugaaacuaagcugguucaggaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauuaggaucccuuggaugcaaaccacuaaccauguuucuuauagcagaaaacaaaaucuggggaaggagaaguuggccccucaaugaaggaaucauggcuguuggaauagucagcauccuacuaaguucacuccuuaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagcaaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagaaauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacgguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggacugaaaagaggagaaacaaccaaacaugcagugucgagaggaaccgcuaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuuguauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaacccgaaggggcacucugguga

SEQ ID NO: 5894 - RNA, 9879 nt, Artificial Sequence
  derived and/or modified CDS sequence (wt) from DENV-1__FJ882554__SS-prME
ucuguaaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaucaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauacaguauagcggccagaggguacaucucaacccgagugggcaugggugaagcagcugcaaucuucaugacagccacucccccaggaucaguggaggccuuuccacagagcaacgcaguuaucaaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugcccuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuaucggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5895 - RNA, 9879 nt, Artificial Sequence
  derived and/or modified CDS sequence (wt) from DENV-1__GQ868610__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagaugugguacuggaacauggaagcugcgucaccaccauggcgaaagacaaaccaacauuggacauugaacuccugaagacggaagucacaaacccugccguccugcgcaaacugugcauugaagcuaaaauaucaaacaccaccaccgacucaagauguccaacacaaggagaagccacacucauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauacucaguaauagucaccguccacacuggagaccaacaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccaacauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauacggaguuuuguucagcgguguuuccuggaccaugaaaauaggaauagggguucugcugacauggcuaggauuaaacucaaggagcacgucccuuucaaugacgugcauugcaguuggccuaauaacacuauaccuaggagucaugguucaggcggauucaggauguguaauuaauuggaaagguagagagcucaaauguggaaguggcauuuuugucaccaaugaaguucacacuuggacagagcaauauaaauuucaagcugacuccccaaagagauuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggaguaacggaguucuggaaagugaaaugauaauuccaaagaucuauggaggaccaauaucucagcacaacuacagaccaggauauuucacacaaacggcagggccguggcaucuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggagcagaaaaauguugaugacuggaacacuggcuguguuccuccuucucauaauggggcaauugacauggaaugaucugaucagauuauguaucaugguuggagccaacgcuuccgacaggauggggaugggaacgacguaccuagcucugauagccacuuuuaaaaugagaccaauguuugcugucgggcuacuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuuuacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccauuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggacgaagagagagaugacacgcuaaccauucuccuuaaagcaacucugcuagcaguuucagggguguacccacuaucaauaccagcgacccuuuuugugugguacuuuuggcagaaaaagaaacagagaucuggagugcuaugggauacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaagugggaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucccccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauccuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuucuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaucaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggaggggucuccaggaaaauuuuggaacaccacgauagcgguuuccauggcaaacauuuucagaggaaguuaucuagcaggagcaggucuagccuucucauuaaugaaaucuuuaggaggagguaggagaggcacgggagcccaaggggaaacacugggagagaaauggaaaaggcagcugaaccaacugagcaagucagaauucaacacuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacguguccuaaaaaugguggaaccauggcucagagggaaccaauuuugcauaaaaauucuaaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggauguuauccccauggucacacaaauagccaugacugacacuacacccuuuggacaacagaggguguucaaagagaaaguugacacgcgcacaccaaaagcaaaacgaggcacagcacaaaucauggaggugacagccaaaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacugauugggaaugagaauuaucuagauuacaugacaucaaugaagagauucaagaacgagggcgaucccgaaggggcacucugguga

SEQ ID NO: 5896 - RNA, 9879 nt, Artificial Sequence
  derived and/or modified CDS sequence (wt) from DENV-1__GQ868611__SS-prME
ucugugaccauguuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugacuugugugaggguaccacaguuguuguggaugaacauuguggaaaucgaggaccaucucuuaggaccacaacagucacaggaaagauaauucaugaaugguguugcagaucuugcacguuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagcugaccuaucauuagagaaagcggcugaggucuccugggaagaagaagcagaacacucuggugccucacacaauauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuacagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccagagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucuaugaagagauucaagaacgagagugaucccgaaggggcacucugguga

SEQ ID NO: 5897 - RNA, 9879 nt, Artificial Sequence
  derived and/or modified CDS sequence (wt) from DENV-1__FJ882555__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcuauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacauugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucagcaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucuuauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauagucacugacaaagagaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguucuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaaaaaaaugauuaggccacaacccauggaguacaaauacucguggaaaagcuggggaaaagcuaaaaucauaggggcagaugugcagaauaccaccuucaucaucgacggccaaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuccucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccaugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaguaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccaggggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcucacuggacagaagcaaaaaugcuccuugauaauauaaacacaccagaaggaauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaagggggcuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaaccauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggcccugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcagaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagcuaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagagcucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5898 - RNA, 9879 nt, Artificial Sequence
  derived and/or modified CDS sequence (wt) from DENV-1__GQ199821__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucagugauagucaccguccacacuggagaccagcaccaggugggaaaugaaaguacagaacaugggacaacugcaacuauaacaccucaagcuccuucgacggaaauacagcugaccgacuauggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauaguuacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcgacugccagaggagcacgaaggauggccauacuaggagacaccgcaugggacuuugguucuauaggaggaguguucacgucuguuggaaaguuaguacaccagauuuuuggaacugcauauggaguuuuguucagcgguguuuccuggaccaugaaaauaggaauaggaguucugcuaacauggcuaggacuaaacucaaggagcacgucccuuucgaugacgugcauuguaguuggccuaguaacauuauaccuaggagucaugguucaggcagauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauagccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcuauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauacauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaauauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5899 - RNA, 9879 nt, Artificial Sequence
  derived and/or modified CDS sequence (wt) from DENV-1__FJ882556__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguagaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcuacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagaccuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuucugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggcuuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcuaugggcuaccuugcuguccuugacauuuaucaaaacaacguuuuccuugcacuacgcauggaaaacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucagguuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacucugaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagagaaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugacagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5900 - RNA, 9879 nt, Artificial Sequence
  derived and/or modified CDS sequence (wt) from DENV-1__GQ199822__SS-prME
ucugugaccaugcuucucaugcugaugcccacagccuuggcguuccaucugacuacacgagggggagagccgcacaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggaucauuuucauuuuguuaaugcugguaacaccauccauggccaugcggugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgcccuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaagagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaagucaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguuuuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacugacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagagaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccuuaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaacaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuagacaaccuggucauguugcacaacuccgaacaaggaggaagagccuauagacaugcaauggaagaauugccagacaccauagaaacgcugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacaggcaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaacccacugacgcugacagcggcgguguugaugcuaguggcucauuacgccauaauuggaccuggacugcaagcaaaagcuacuagagaagcucaaaaaaggacagcggccggaauaaugaaaaauccaaccguagauggaauuguugcaauagacuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacuacacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcuguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuauccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacugauugggaaugagaauuaucuagauuacaugacaucaaugaagagauucaagaacgagggugaucccgaaggggcacucugguga

SEQ ID NO: 5901 - RNA, 9879 nt, Artificial Sequence
  derived and/or modified CDS sequence (wt) from DENV-1__FJ882557__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuucgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaauauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggccaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagcuuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuacucccaggugaauccacugacgaugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucccuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacgugugucuacaacaugauggggaagagagagaaaaaacuaggagaguuuggaaaggcaaaaggaagucgugcaauaugguacaugugguugggagcacguuuucuagaguucgaagcucuugguuucaugaacgaagaccauugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacacgcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcagcaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacagaagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5902 - RNA, 9879 nt, Artificial Sequence
  derived and/or modified CDS sequence (wt) from DENV-1__FJ882558__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaagaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuguuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaaguucagccgaccuaucacuagagaaagcagcugaggucuccugggaagaagaagcagaacacucuggugccucacacaacauauuaguagagguccaagaugauggaaccaugaagauaaaggaugaagagagagaugacacgcuaaccauucuccuuaaagcaacucugcuaacagucucagggguguacccauuaucaauaccagcgacccuuuuugugugguacuuuuggcagaaaaagaaacagagaucuggaguguuaugggacacaccuagcccuccaaaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuugacaauaauggaccuacauccaggaucggggaaaacaagaagauaucuuccagccauaguccgugaggccauaaaaaggaagcugcgcacauuaauucuggcucccacaagaguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguauaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacguacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgaugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccuaacagccauugcaaaccaggcggcuauauugaugggacuugacaaaggauggccaauaucgaagauggacauaggaguuccacuucucgccuuagggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauaguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccaggagaguucuugacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccaguugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaucaagugagaagacuaauugggaaugagaauuaucuagauuacaugacaucaaugaagagauucaagaacgagagugauccugaaggugcacucugguga

SEQ ID NO: 5903 - RNA, 9879 nt, Artificial Sequence
  derived and/or modified CDS sequence (wt) from DENV-1__GQ199824__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacucgguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugauucaagauguccaacacaaggagaagccacacugguggaagaacaagacgcgaacuuugugugucgacgaacguuuguggauagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaaucuuugcaggacacuugaaauguagacuaaagauggacaagcugacucuaaaagggaugucauauguuaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauauuaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacaucugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguugugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaucaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacgacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggagaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccacuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgcuauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguugcggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaagucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaauaagaaaccgagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuugugggcagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauagggaaugagaauuaucuagauuacaugacaucaaugaagagauucaagaacgagagugauccugaaggggcacucugguga

SEQ ID NO: 5904 - RNA, 9879 nt, Artificial Sequence
  derived and/or modified CDS sequence (wt) from DENV-1__FJ882559__SS-prME
ucugugaccaugcuccuuaugcugaugcccacagcauuggcguuccauuugacuacacgagggggagagccgcacaugauagucagcaagcaggaaagaggaaagucacuuuuguuuaagaccucagcaggugucaacaugugcacccucauagcgauggauuugggagaguuuugugaggacacaaugacuuacaaaugcccucgaaucacugaggcggaaccagaugacguugauuguuggugcaaugccacagacacaugggugaccuauggaacauguucucaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguggaaggacuaucaggagcaacuuggguagaugugguacuggaacauggaaguugcgucaccaccauggcaaaagacaaaccaacauuggacauugaacucuugaaaacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaaccugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauacguaaugugcacaggcucauucaagcuagagaaagaaguggcugagacccagcauggaaccguucuagugcagaucaaauaugaaggaacagaugcaccaugcaagauuccuuuuucgacccaagaugaaaaaggaguaacucagaaugggagacugauaacagcuaaccccauagucacugacaaagaaaaaccagucaacauugaggcagaaccaccuuuuggugagaguuacaucgugauaggagcaggugaaaaagcuuugaaacuaagcugguucaagaaaggaagcagcauaggaaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagugguguuuccuggaccaugaaaauaggaauagggguucugcugacauggcuaggauugaacucaaggagcacgucccuuucgaugacgugcauugcaguuggcuuaguaacacuauaucuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugagaaugacaugaaauucacagugguuguaggagauguugcuggaauuuuggcucaagggaaaaaaaugauuaggccacaacccauggaauacaaauacucauggaaaagcuggggaaaggcuagaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugagguugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacccuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaguucaugaaugguguugcagaucuuguacgcuaccacccuuacguuucaaaggagaagaugggugcugguacgguauggaaaucagaccagucaaagaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaaugacguaccuagcucugauggccacuuuuaaaaugagaccaauguuugcuguaggacuauuauuccgcagacuaacauccagagaaguucuucuucuaacaauuggauuaagucuaguggcaucugcggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauugugucucucuuucccuuaugucuguccacgaccucccaaaaaacaacauggcuuccggugcuauugggaucucuuggaugcaaaccacuaaccauguuucuuauagcagaaaacaaaaucuggggaaggaaaaguuggccccuuaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaagaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaaugugcaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcuccuacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcuaggaaaacguuuguggagcucaugagaagaggagaucuaccugucuggcuauccuacaaaguugccucagaaggcuuucaguacucugacagaagauggugcuuugacggggaaaggaacaaccaggugcuggaggagaacauggacguggagaucuggacaaaagaaggagaaagaaagaaacuaagaccccgcuggcuggaugcuagaacauacucagacccacuagcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaagaacugccagacaccauagaaacauugaugcuucuggcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucagaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacgugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaaggggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaagacugcacuccgggaaagacguauucuuuacaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcagugaacaugacauccagaauguugcuaaaucgauucacaauggcccacaggaaaccaacauaugaaagagacguggaccuaggcgcuggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaguacaaaucauggaggugacagccaagugguuaugggguuuucuuucuagaaauaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaauacuuucaccaacauggaagcccagcugauaagacagauggagucugagggaaucuuuucacccagcgaguuagagaccccaaauuuagccgagagagcucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucagugguguggaucccugauaggcuuaacagcaagggcuaccugggccacuaacauacaaguggccauaaaccaagugagaagacuaauugggaaugagaauuaucuagauuacaugacaucaaugaagagauucaagaacgagagugauccugaaggggcacucugguga

SEQ ID NO: 5905 - RNA, 9879 nt, Artificial Sequence
  derived and/or modified CDS sequence (wt) from DENV-1__GQ199828__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacauguguacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaaccuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcagauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacaugugucuggccaaaaucccacacucuauggagcaauggaguucgggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugauuggaacacuggcuguguucuuccuucucauaaugggacaauugacauggaaugaucugaucagauuaugcaucaugguuggagccaacgccuccgacaggauggggaugggaacgacguaucuagcucuaauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaagaaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacuacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggucuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggagaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucucugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaggcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugagucaucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugaggaaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgauaaggcuaucgggucagccguuccaguagauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccacuaacauacaaguggcuauaaaccaagugagaagacuaauugggaaugagaauuaucuagauuacaugacaucaaugaagagauucaagaacgagagugaucccgaaggggcacucugguga

SEQ ID NO: 5906 - RNA, 9879 nt, Artificial Sequence
  derived and/or modified CDS sequence (wt) from DENV-1__GQ199829__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacgcuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaagaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccauaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucggccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5907 - RNA, 9879 nt, Artificial Sequence
  derived and/or modified CDS sequence (wt) from DENV-1__FJ882562__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacgguaauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggacuguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuugucaccaaugaaguucauacuuggacagagcaauacaaauuucaagcugauuccccaaagagacuaucagcagccauugggaaggcaugggaggaagguguguguggaauucgaucagcaacucgucucgagaacaucauguggaagcaaauaucaaaugaauugaaccacaucuuacuugaaaaugacaugaaacucacagugguuguaggagauguugcugggaucuuggcucaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaccuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacauuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacagacagcgccgggcaccuuuaagaccccugaaggcgaaguuggagccauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaauuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggacgaagcacauuuuaccgauccauccagcauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcgaggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugaugacuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguggcagccaaugagaugggacugcuagaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauaggaguuccacuucucgcuuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggcccugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5908 - RNA, 9879 nt, Artificial Sequence
  derived and/or modified CDS sequence (wt) from DENV-1__FJ882564__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaaccauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaaugguugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucuuuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuacagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuauaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaacuagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcagaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5909 - RNA, 9879 nt, Artificial Sequence
  derived and/or modified CDS sequence (wt) from DENV-1__FJ882565__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacggagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcguggcuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgcgaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5910 - RNA, 9879 nt, Artificial Sequence
  derived and/or modified CDS sequence (wt) from DENV-1__FJ882567__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaaggaaaaaaaaugauuaggccacaaccuauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucuuuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuacagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguagucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaacuagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcagaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgaaaggguucucgacuggcuggaaaaacauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5911 - RNA, 9879 nt, Artificial Sequence
  derived and/or modified CDS sequence (wt) from DENV-1__GQ199831__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugagacggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuuuuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaaugguugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagagagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaccgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcuguugggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucucauagcagaaaacaaaaucuggggaaggaaaaguuggccccucaaugaaggaaucauggcuguuggaguagucaguauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcuacgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccaggcaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacuacaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaaaucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaauauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguagugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgccaaugcuaucuguucagccgauccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5912 - RNA, 9879 nt, Artificial Sequence
  derived and/or modified CDS sequence (wt) from DENV-1__GQ199832__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuuuuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaaggaaaaaaaaugauuaggccacaaccuauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucuuuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuacagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauaaacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucauaauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaacuagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuauaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcagaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5913 - RNA, 9879 nt, Artificial Sequence
  derived and/or modified CDS sequence (wt) from DENV-1__FJ882568__SS-prME
ucugugaccaugcuucuuaugcugaugcccacagccuuggcguuccaccugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacgguuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucugaaagggaugucauaugugaugugcacaggcucauucaagcuagagaaagaaguggcugagacccagcauggaaccguuuuagugcagauuaaauacgaaggaacagaugcaccaugcaagaucccuuuuuugacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaaggaaaaaaaaugauuaggccacaaccuauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucuuuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuacagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucauaauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcagccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaacuagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcagaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5914 - RNA, 9879 nt, Artificial Sequence
  derived and/or modified CDS sequence (wt) from DENV-1__FJ882569__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcuuugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauaguuacugauaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaaggaaaaaaaaugauuaggccacaaccuauggaacacaaauacucguggaaaagcuggggaaaagcuaaaaucauaggggcagauguacagaacaccaccuucaucaucgacggcccaaacaccccggaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguauuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguuucucuuuuccccuuaugccuguccacgaccucccaaaaaacaacguggcuuccggugcuauugggaucucuuggaugcaaaccacuaaccauguuucuuauagcagaaaacaaaaucuggggaaggagaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuacagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaucccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucgggaaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcaguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaacuagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcagaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauacaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5915 - RNA, 9879 nt, Artificial Sequence
  derived and/or modified CDS sequence (wt) from DENV-1__GQ199833__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacagacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguccaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaaggaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugauugaagaggugaugagauccagauggaguagaaaaauguugaugacuggaacacuggcuguguuccuccuucucauaauggggcaauugacauggaaugaucugaucagacuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcaaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccauaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcagaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgaaagaguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagacauaccacaaugggaaccuucaaaaggauggaaugacuggcaacaagugccuuuuuguucacaccacuuucaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagcuguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5916 - RNA, 9879 nt, Artificial Sequence
  derived and/or modified CDS sequence (wt) from DENV-1__FJ882570__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagagcaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggagauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucaacccaagauggaaaaggaguaacccagaauggaagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaaggaaaaaaaaugauuaggccacaaccuauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuguuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucuuuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccauugauagcuggaggcaugcuaauagcauguuauguuauaucuggaagcucagccgacuuaucacuagagaaagcggcugaggucuccugggaagaagaagcagaacacucuggugccucacacaauauauucguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcagcucuugaugaugguaucuacagaaucaugcagagaggacuguugggcaggucccaaguagggguaggaguuuuucaagaaaacguguuccacacaauguggcaugucaccaggggagcuguacucauguaucaagggaagagacuggaaccgaguugggccagcgucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaauagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcauaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucauaauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucacuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaacuagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcauuccgggaaggacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauuuuaaaucccuacaugccaagugugguggaaacucuggagcagaugcaaagaaaacauggaggaaugcuagugcgaaauccacuuucaagaaauucuacucaugaaauguauuggguuucauguggaacaggaaacaucgugucagcaguaaacaugacaucuagaauguugcugaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacagauggagucugagggaaucuuuuuacccagcgaauuggagaccccaaauuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagacauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5917 - RNA, 9879 nt, Artificial Sequence
  derived and/or modified CDS sequence (wt) from DENV-1__GQ199834__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcauugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaacuggcugagacccagcauggaaccguuuuagugcagaucaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguagaugggaucuuggcucaagggaaaaaaaugauuaggccacaacccauggaacacaaauacucguggaaaagcuggggaaaagccaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucucauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugacggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugauuucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcucugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagaccuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucccuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaagaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaagaugguggaaccauggcucagagggaaccaauuuugcauaaaaauccuaaaucccuacaugccaagugugguugaaacucuggagcagaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagaaaauucacucagcggaguggaaggagaaggacuccacaaacucggauacauacucagagacauaucaaagauuccagggggaaauauguaugcagaugacacagccggaugggauacgaggauaacagaggaugaucuucagaaugaggccaaaauuacugacaucauggagcccgagcaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagagugucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcuagggcuaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5918 - RNA, 9879 nt, Artificial Sequence
  derived and/or modified CDS sequence (wt) from DENV-1__GQ199835__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauucuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacucauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacacuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuuguuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcgugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcagauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacacuguggaaaucgaggaccaucucuuagaaccacaacagucacaggaaagauaauucaugaaugguguugcagaucuuguacgcuaccacccuuacguuuuaaaggagaggacggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuaacucugauggccacuuuuaaaaugagaccaauguuugcugucgggcuauuacuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugucuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcaguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccauugugaacagagaagggaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaagacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgauagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggcuggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucuuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacacguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacaccacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggguggagccugagagaaacugcaugccuaggcaagucauaugcacaaauguggcagcugauguacuuccacaggagagaccugagacuagccgcuaaugccaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuaggaaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5919 - RNA, 9879 nt, Artificial Sequence
  derived and/or modified CDS sequence (wt) from DENV-1__FJ898386__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcagaaccagaugacguugauuguuggugcaaugccacagacacaugggugaccuauggaacauguucccaaacuggugagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaaaauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcccaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuggcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggauauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagccgccggaauaaugaaaaauccaaccguugauggaauuguugcaauagauuuggacccuguggucuaugaugcaaaauuugagaaacaacuaggccaaauaauguuauuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaauauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaggugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaaucuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaacaggguuuggauagaggaaaacccauggauggaggacaaaacccauguauccaguugggaagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcauucugguga

SEQ ID NO: 5920 - RNA, 9879 nt, Artificial Sequence
  derived and/or modified CDS sequence (wt) from DENV-1__FJ898387__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcaauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauaccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagcugaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugauacaaaauuugagaaacaacuaggccaaauaauguuguugauacuauguacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauaucuagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaagacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5921 - RNA, 9879 nt, Artificial Sequence
  derived and/or modified CDS sequence (wt) from DENV-1__FJ898389__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggacuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacguaggacuugguuuagaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacgaacccugccguccugcgcaaacugugcauugaagcuaaaauaucaaauaccaccaccgacucaagauguccaacacaaggagaagccacacucauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacacuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuuguuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggccccaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacacuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccucuuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuauccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucuuuuggaugcaaaccacuagccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcaguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccauugugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauucaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaagacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgauagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaggcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuggggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuacucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucacuaaugaaaucuuugggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccucgugaaaccagaagggaaagucauagaccucggcuguggaagagguggcuggucauacuauugugcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacacguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaccuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugauagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugccaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuaggaaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagguucaagaacgagggugaucccgaaggggcacucugguga

SEQ ID NO: 5922 - RNA, 9879 nt, Artificial Sequence
  derived and/or modified CDS sequence (wt) from DENV-1__FJ898390__SS-prME
ucugugaccaugcuacuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacucaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaaugguuucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaagaugagaccaauguuugcugucgggcuauuauuccguagacuaacauccagagaaguucuccuucucacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaucaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccuccugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaauccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacagggaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguagugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5923 - RNA, 9879 nt, Artificial Sequence
  derived and/or modified CDS sequence (wt) from DENV-1__FJ898391__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaauguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagagugucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5924 - RNA, 9879 nt, Artificial Sequence
  derived and/or modified CDS sequence (wt) from DENV-1__FJ898392__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaaccggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaaugcggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaaggaaaaaaaaugauuaggccacaaccuauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcagacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggaugggugcugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuauguaucaugguuggagccaacgcuuccgacaggauggggaugggaacgacguaccuagcucugauggccacuuuuaaaaugagaccaauguuugcugucgggcuauuauuccguagacuaacauccagagaaguucuucuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucuuuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuacagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaagagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuauguugucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaacauaaacacaccagaagggauuaucccagcccucuucgagccagagagggaaaagagugcagcaauagacggggaauauagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucauaauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucucugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaucaacugagcaagucagaauucaacauuuacaaaaggagugggauaauggaaguggacagauccgaagccaaagagggacugaaaagaggagaaacaacuagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauacacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacuuuggagcagaugcaaagaaaacacggaggaaugcuagugcgaaauccacuuucaagaaauucuacucaugaaauguauuggguuucauguggaacaggaaacauugugucagcaguaaacaugacaucuagaauguugcuaaaucgauucacaauggcccacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugagggugcagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaacuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggcuuccaacauacaaguggccauaaaccaagugagaagacuaauugggaaugagaauuaucuagauuacaugacaucaaugaagagauucaagaacgagggugaucccgaaggggcacucugguga

SEQ ID NO: 5925 - RNA, 9879 nt, Artificial Sequence
  derived and/or modified CDS sequence (wt) from DENV-1__FJ898393__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggacugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucauacuuggacagagcaauacaaauuucaagcugacuccccaaagagacuaucagcagccaucgggagggcaugggaggaggguguguguggaauucgaucagccacucgucucgagaauaucauguggaagcaaauaucaaaugaacugaaccacaucuuacuugaaaaugacaugaaauucacagugguugugggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauugcaucucucuuccccuuaugccuguccacgaccucccaaaaaacaacguggcuuccggugcuauugggaucucuuggaugcaaaccacuaaccauguuucuuauaacagaaaccaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaacauauuaguggugguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaagccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggaggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaauccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5926 - RNA, 9879 nt, Artificial Sequence
  derived and/or modified CDS sequence (wt) from DENV-1__FJ898394__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugagggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacucauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacacuggauugcucacccagaacaggacuagacuuuaaugaaaugguguuguugacaaugaaagaaaaaucauggcuaguccauaaacaaugguuucuagaccuaccacugccuuggaccucaggagcuucaacaccacaagagacuuggaacagacaagauuugcuggugacauuuaagacagcucaugcaaagaagcaggaaguagucguacuaggaucacaagaaggggcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacauaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcgagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaauuuagucaaaucaauggucucugcagggucaggggaaguggacagcuuuucacuaggacuacuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacguuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauucccuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaacccuaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcauuaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccaaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagcgcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaagacauccaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguacugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaaugacucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcuguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaagcucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuuuaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagcugagaggguucucgacuggcuggaaaaacauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugucuaggcaagucguaugcacaaauguggcagcugauguacuuccauaggagagaccugagacuagccgcuaaugcuaucuguucagccguuccaguugauugggucccaaccagucgcaccacuuggucgauccaugcccaccaccaauggaugacaacagaagacauguugucaguguggaauaggguuuggauagaggaaaacccauggauggaggacaaaacucauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5927 - RNA, 9879 nt, Artificial Sequence
  derived and/or modified CDS sequence (wt) from DENV-1__GQ199838__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaaccggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacgcuuguggacagaggcuggggcaauggcugugggcucuucggaaaaggaagucuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccaccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaaggaaaaaaaaugauuaggccacaaccuauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcagacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuauguaucaugguuggagccaacgcuuccgacaggauggggaugggaacgacguaccuagcucugauggccacuuuuaaaaugagaccaauguuugcugucgggcuauuauuccguagacuaacauccagagaaguucuucuucuuacaauuggauugagucuaguggcaucuguggaguuaccaaauuccuuggaggaguugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucuuuuccccuuaugccuguccacgaccucccaaaaaacaacguggcuuccggugcuauugggaucucuuggaugcaaaccacuaacuauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaacauauuaguggagguccaagaugauggaacuaugaagauaaaggaugaagagagagaugacacgcuaaccauucuccuuaaagcaacuuugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuacagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaagagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauauagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucauaauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacuauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaucaacugagcaagucagaauucaacauuuacaaaaggagugggauaauggaaguggacagauccgaagccaaagagggacugaaaagaggagaaacaacuagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauacacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcagaugcaaagaaaacacggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaaggaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggggggaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugagggugcagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaauuuuuuuacccagcgaauuggagaccccaaauuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5928 - RNA, 9879 nt, Artificial Sequence
  derived and/or modified CDS sequence (wt) from DENV-1__FJ898396__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuagccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaggauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaacuauugacugacuuucagucacaucagcugugggcuaccuugcuguccuugacauuuauuaaaacaacgcuuuccuuacacuaugcauggaagacaauggcuaugguauugucaauugcaucucucuuccccuuaugccuguccacgaccucccaaaaaacaacguggcuuccggugcuauugggaucucuuggaugcaaaccacuaaccauguuucuuauaacagaaaccaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggugguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaagccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacgacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucacacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcggccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggaggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaauccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5929 - RNA, 9879 nt, Artificial Sequence
  derived and/or modified CDS sequence (wt) from DENV-1__GQ199839__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccgaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggagauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggagugacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcuugaaauucacagugguuguaggagauguaguugggaucuuggcucaagggaaaaaaaugauuaggccacaaccuauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggauuauggauuugggauuuucacgacaaauauaugguugaaauugcgugacuccuacacccaagugugugaccaccggcuaaugucagcugccaucaaggacagcaaggcaguucaugcugauaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucuuuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccauugauagcuggaggcaugcuaauagcauguuauguuauaucuggaagcucagccgacuuaucacuagagaaagcggcugaggucuccugggaagaagaagcagaacacucuggugccucacacaauauauucguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcagcucuugaugaugguaucuacagaaucaugcagagaggacuguuggguaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuucaaacccggcacaucuggaucucccaucgugaacagagaaggaaaaauaguaggucuuuauggaaauggaguggugacaacaaguggaaccuacgucagugccauagcucaaaccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcgggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucauaauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucacuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaacuagacaugcagugucgagaggaaccgccaaauugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcauuccgggaaggacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauuuuaaaucccuacaugccaagugugguggaaacucuggagcagaugcaaagaaaacauggaggaaugcuagugcgaaauccacuuucaagaaauucuacucaugaaauguauuggguuucauguggaacaggaaacaucgugucagcaguaaacaugacaucuagaauguugcugaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagacauaccacaaugggaaccuucaaaaggauggaaugacuggcaacaagugccuuuuuguucacaccacuuccaccagcugauaaugaaggacgggagggaaauaguggugccaugucguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5930 - RNA, 9879 nt, Artificial Sequence
  derived and/or modified CDS sequence (wt) from DENV-1__FJ898397__SS-prME
ucugugaccaugcuccuuaugcugaugccuacagccuuggcguuccauuugacuauacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcguauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucacugauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaaaaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguugugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuacgucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 5931 - RNA, 9879 nt, Artificial Sequence
  derived and/or modified CDS sequence (wt) from DENV-1__FJ898398__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcagaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaaucuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuucaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacgauaauggaccuacauccaggaucggggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugaucaucauggaugaagcacauuucaccgauccauccagcauagcggccagaggguacaucucaacccgggugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagagcauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagguccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaguuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucaacuggcuggaaaaacauggcgucgaaaggcugaaaagaauggcaaucagcggagaugacugcguagugaaaccaauugaugauagguuugcaacagcuuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5932 - RNA, 9879 nt, Artificial Sequence
  derived and/or modified CDS sequence (wt) from DENV-1__FJ898399__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagccaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuaucggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcagucggccuaguaacgcuauacuuaggagucaugguucaggcagauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuagcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaagacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacaccuuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5933 - RNA, 9879 nt, Artificial Sequence
  derived and/or modified CDS sequence (wt) from DENV-1__FJ898401__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggauggacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaaaaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuuguguggcacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccauggggaaacacugggagagaaauggaaaagacagcugaaccaacugagcaagucagaauucaacacuuauaaaaggagugggaucauggaaguggacagaucugaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaaaaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguugugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 5934 - RNA, 9879 nt, Artificial Sequence
  derived and/or modified CDS sequence (wt) from DENV-1__FJ898402__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaaccauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuguaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaacuacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagcuaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuuuccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggacggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcaaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5935 - RNA, 9879 nt, Artificial Sequence
  derived and/or modified CDS sequence (wt) from DENV-1__FJ898403__SS-prME
ucugugaccaugcuccuuaugcugaugccuacagccuuggcguuucauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguugugggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccauuaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauguaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 5936 - RNA, 9879 nt, Artificial Sequence
  derived and/or modified CDS sequence (wt) from DENV-1__FJ898404__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuagccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaggauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaacuauugacugacuuucagucacaucagcugugggcuaccuugcuguccuugacauuuauuaaaacaacgcuuuccuuacacuaugcauggaagacaauggcuaugguauugucaauugcaucucucuuccccuuaugccuguccacgaccucccaaaaaacaacguggcuuccggugcuauugggaucucuuggaugcaaaccacuaaccauguuucuuauaacagaaaccaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggugguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaagccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacgacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcggccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggaggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaauccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5937 - RNA, 9879 nt, Artificial Sequence
  derived and/or modified CDS sequence (wt) from DENV-1__GQ199840__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacuaguggaagaacaagacgcgaacuuugugugucgacgaacguucguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacuucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguaggaaaaugcugaugacuggaacacuggcuguguucuuccuucucauaacgggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggauauaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggcuagugccgcccagaggagaggaagaauuggaaggaaccacaacaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacguacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguagugauagguuuguuauucaugauacugacaguagcagccaaugagaugggacugcuggaaaccacaaagaaagacuuagggauuggccauguggcugcugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaauucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaauauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccagcuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5938 - RNA, 9879 nt, Artificial Sequence
  derived and/or modified CDS sequence (wt) from DENV-1__FJ898405__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuucaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguaacauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacacaagugugugaccaucggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguaggaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuaucaaaacaacgcuuuccuuacauuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaacauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcaccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcuccuacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaggcagcugcgaucuucaugacagccacucccccaggaucaguggaggccuuuccacagagcaaugcaguuauccaagaugaggaaagagacauuccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuccgaccccgcuggcuggaugccagaacauacucagacccacuggcccugcgcgaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaaaauggacauaggaguuccacuucucgccuuggggugcuauucacaggugaauccacugacgcugacagcggcgguauugaugcuaguggcucauuacgccauaauuggaccuggacugcaagcaaaagccacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacaacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgcgaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuucacccagcgaauuggagaucccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccucuaacauacaaguggccauaaaccaagugagaagacuaauugggaaugagaacuaucuagauuacaugacaucaaugaagagauucaagaacgagggugaucccgaaggggcacucugguga

SEQ ID NO: 5939 - RNA, 9879 nt, Artificial Sequence
  derived and/or modified CDS sequence (wt) from DENV-1__FJ898406__SS-prME
ucugugaccaugcuucuuauguugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuucaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguaacauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaucggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaccgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuaucaaaacaacgcuuuccuuacauuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaacauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcaccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcuccuacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucuccugugagaguucccaauuacaacaugauuaucauggaugaagcacauuucaccgauccauccaguauagcagccagaggguacaucucaacccgagugggcaugggugaggcagcugcgaucuucaugacagccacucccccaggaucaguggaggccuuuccacagagcaaugcaguuauccaagaugaggaaagagacauuccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuccgaccccgcuggcuggaugccagaacauacucagacccacuggcccugcgcgaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaaaauggacauaggaguuccacuucucgccuuggggugcuauucacaggugaauccacugacgcugacagcggcgguauugaugcuaguggcucauuacgccauaauuggaccuggacugcaagcaaaagccacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacaacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacuaaaaagaggagaaacaaccagacaugcagugucgcgaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuucacccagcgaauuggagaucccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccucuaacauacaaguggccauaaaccaagugagaagacuaauugggaaugagaacuaucuagauuacauggcaucaaugaagagauucaagaacgagggugaucccgaaggggcacucugguga

SEQ ID NO: 5940 - RNA, 9879 nt, Artificial Sequence
  derived and/or modified CDS sequence (wt) from DENV-1__GQ199841__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagagcuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggcgcuggauggagccugagagaaacugcaugccuaggcaagucauaugcacaaauguggcaguugauguacuuccacaggagagaccugagacuagccgcuaaugcuaucuguucagccguaccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5941 - RNA, 9879 nt, Artificial Sequence
  derived and/or modified CDS sequence (wt) from DENV-1__FJ898407__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggaucauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagucugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguuuuagugcagauuaaauacgaaggaacagaugcaccaugcaagauccccuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuccuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaaaccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauauuagagauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugucuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5942 - RNA, 9879 nt, Artificial Sequence
  derived and/or modified CDS sequence (wt) from DENV-1__FJ898408__SS-prME
ucugugaccaugcuucuuaugcugaugcccacagccuuggcguuccaucugaccacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaaccggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaaugcggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaaggaaaaaaaaugauuaggccacaaccuauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcagacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuauguaucaugguuggagccaacgcuuccgacaggauggggaugggaacgacguaccuagcucugauggccacuuuuaaaaugagaccaauguuugcugucgggcuauuauuccguagacuaacauccagagaaguucuucuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucuuuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuacagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaagagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugauuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuauguugucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauauagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucauaauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaucaacugagcaagucagaauucaacauuuacaaaaggagugggauaauggaaguggacagauccgaagccaaagagggacugaaaagaggagaaacaacuagacaugcagugucgagaggaaccgccaaacugaggugguuuguggagaggaaccuugugaaaccagaagggaaagucauagaccucggcugugggagagguggcuggucauacuauugcgcugggcugaagaaagucacagaagugaagggauacacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacuuuggagcagaugcaaagaaaacacggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuauggggguuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuucacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugagggugcagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaacuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccgauccaggugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggcuuccaacauacaaguggccauaaaccaagugagaagacuaauugggaaugagaauuaucuagauuacaugacaucaaugaagagauucaagaacgagggugaucccgaaggggcacucugguga

SEQ ID NO: 5943 - RNA, 9879 nt, Artificial Sequence
  derived and/or modified CDS sequence (wt) from DENV-1__GQ199843__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagucugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucacccagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguuuuaguacagauuaaauacgaaggaacagaugcaccaugcaagauccccuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugagguuucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacaucccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccaguaauacuaaaagaugguccagagcgugucaucuuagcaggaccgaugccagugacuguggccagugccgcccagaggagaggaagaauuggaaggaaccauaauaaggaaggugaucaguacaucuacaugggacagcccuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauauuagagauagggaaacuuccacaacacuugacgcaaagggcccagaaugccuuggacaaccuggucauguugcacaacuccgaacaaggaggaagagccuauagacaugcaauggaagaacugccagacaccauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccaugcggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaauugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugaaagguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugucuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5944 - RNA, 9879 nt, Artificial Sequence
  derived and/or modified CDS sequence (wt) from DENV-1__GQ199844__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaauugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaggauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauugcaucucucuuccccuuaugccuguccacgaccucccaaaaaacaacguggcuuccggugcuauugggaucucuuggaugcaaaccacuaaccauguuucuuauaacagaaaccaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggugguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaagccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcggccauuggagcaguguucguugaugaaaaucaauggaacucagcaaaagaagcaguggaagaugaacgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggaggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaauccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5945 - RNA, 9879 nt, Artificial Sequence
  derived and/or modified CDS sequence (wt) from DENV-1__GQ199845__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacuuuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaauguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauagcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaaucuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggagcagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuucaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccacaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugaucaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaauuugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacaggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagguccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucauaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauacauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaaguggugaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5946 - RNA, 9879 nt, Artificial Sequence
  derived and/or modified CDS sequence (wt) from DENV-1__GQ199846__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaucauggcgagagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauuuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauugcaucucucuuccccuuaugccuguccacgaccucccaaaaaacaacguggcuuccggugcuauugggaucucuuggaugcaaaccacuaaccauguuucuuauaacagaaaccaaaaucuggggaaggaaaaguuggccccucaaugaaggaaucauggcuguuggaguagucagcauccuacuaaguucacuccucaaaaaugaugugccgcuagcugggccucuaauagcuggaggcaugcuaauagcauguuauguuauaucuggaagcucagccgacuuaucacuagagaaagcggcugaggucuccugggaagaagaagcagaacacucuggugccucgcacaauauauuaguggugguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucucgaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaagccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagaguaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauuuuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucaagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggaggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaaggggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaauccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5947 - RNA, 9879 nt, Artificial Sequence
  derived and/or modified CDS sequence (wt) from DENV-1__GQ199847__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuaucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguucgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauccaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccgauccagaugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 5948 - RNA, 9879 nt, Artificial Sequence
  derived and/or modified CDS sequence (wt) from DENV-1__GQ199849__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccgaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggagauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacuggcucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggagugacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcuugaaauucacagugguuguaggagauguaguugggaucuuggcucaagggaaaaaaaugauuaggccacaaccuauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggauuauggauuugggauuuucacgacaaauauaugguugaaauugcgugacuccuacacccaagugugugaccaccggcuaaugucagcugccaucaaggacagcaaggcaguucaugcugauaugggguacuggauagaaagugaaaggaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucuuuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccauugauagcuggaggcaugcuaauagcauguuauguuauaucuggaagcucagccgacuuaucacuagagaaagcggcugaggucuccugggaagaagaagcagaacacucuggugccucacacaauauauucguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcagcucuugaugaugguaucuacagaaucaugcagagaggacuguuggguaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuucaaacccggcacaucuggaucucccaucgugaacagagaaggaaaaauaguaggucuuuauggaaauggaguggugacaacaaguggaaccuacgucagugccauagcucaaaccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaacgggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucauaauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucacuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaacuagacaugcagugucgagaggaaccgccaaauugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcauuccgggaaggacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauuuuaaaucccuacaugccaagugugguggaaacucuggagcagaugcaaagaaaacauggaggaaugcuagugcgaaauccacuuucaagaaauucuacucaugaaauguauuggguuucauguggaacaggaaacaucgugucagcaguaaacaugacaucuagaauguugcugaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccaggcgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagacauaccacaaugggaaccuucaaaaggauggaaugacuggcaacaagugccuuuuuguucacaccacuuccaccagcugauaaugaaggacgggagggaaauaguggugccaugucguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5949 - RNA, 9879 nt, Artificial Sequence
  derived and/or modified CDS sequence (wt) from DENV-1__FJ898410__SS-prME
ucugugaccaugcuccuuaugcugacgccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccccgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccagccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauagcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaaucuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggagcagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuucaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugaucaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaacaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuauuacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuagccuucucauuaaugaaaucucuaggaggagguaggagaggcacgggagcccaaggggaaacacugggagagaaauggaaaagacagcugaaccaacugaguaagccagaauucaacacuuauaaaaggagugggaucauggaaguggacagguccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagaaguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucauaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5950 - RNA, 9879 nt, Artificial Sequence
  derived and/or modified CDS sequence (wt) from DENV-1__FJ898411__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacaucuaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugacgguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauccaauugagcagaaaaacuuuugauacagaguaccaaaaaacaaaaaacaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 5951 - RNA, 9879 nt, Artificial Sequence
  derived and/or modified CDS sequence (wt) from DENV-1__FJ898412__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacgucgauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacucauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucagugauagucaccguccauacuggagaccagcaccaggugggaaaugaaagcacagaacaugggacaacugcaacuauaacaccucaagcuccuacgucggaaauacagcugaccgacuacggagcucuuacacuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccauguaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacacuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguccuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccauugugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaagacaguuugguuuguuccaagcaucaaaucaggaaacgacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgauagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaccagcuggcauauguggugauagguuuguuauucaugauacugacaguagcagccaaugagaugggacuacuggaaaccacaaagaaagacuuagggauuggccauguggcuguugaaaaucaccaccaugucacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguguugaugcuaguggcucauuacgccauaauuggaccuggacugcaagcaaaagccacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucuuuaggaggagguaggagaggcacgggagcccaaggggaaacacugggagagaaauggaaaaggcagcugaaccaacugagcaagucagaauucaacauuuacaaaaggagcgggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacacguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcuaaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugucguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugccaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuaggaaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5952 - RNA, 9879 nt, Artificial Sequence
  derived and/or modified CDS sequence (wt) from DENV-1__GQ199852__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuagccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauuguucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaggauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguaggaaaauguugacgacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuucccuuacacugugcauggaagacaauggcuaugguauugucaauugcaucucucuuccccuuaugccuguccacgaccucccaaaaaacaacguggcuuccggugcuauugggaucucuuggaugcaaaccacuaaccauguuucuuauaacagaaaccaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggugguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaagccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacgacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcggccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggaggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaauccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5953 - RNA, 9879 nt, Artificial Sequence
  derived and/or modified CDS sequence (wt) from DENV-1__FJ898415__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggagacaagaaccgaaacguggauguccucugaaggcgcuuggaaacagauacaaagaguggagacuugggccuugagacacccaggauucacggugauagcccuuuuucuagcacaugccauaggaacauccaucacccagaaggggauuauuuucauuuuguuaaugcugguaacaccauccauggcuaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuucaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguaguuguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuuugacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaagcaacauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaucggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagacaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuaucaaaacaacgcuuuccuuacauuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaacauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcaccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcuccuacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaggcagcugcgaucuucaugacagccacucccccaggaucaguggaggccuuuccacagagcaaugcaguuauccaagaugaggaaagagacauuccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuccgaccccgcuggcuggaugccagaacauacucagacccacuggcccugcgcgaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaaaauggacauaggaguuccacuucucgccuuggggugcuauucacaggugaauccacugacgcugacagcggcgguauugaugcuaguggcucauuacgccauaauuggaccuggacugcaggcaaaagccacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgcgaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggacacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuucacccagcgaauuggagaucccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccucuaacauacaaguggccauaaaccaagugagaagacuaauugggaaugagaacuaucuagauuacaugacaucaaugaagagauucaagaacgagggugaucccgaaggggcacucugguga

SEQ ID NO: 5954 - RNA, 9879 nt, Artificial Sequence
  derived and/or modified CDS sequence (wt) from DENV-1__FJ898416__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuagccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaggauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacugguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauugcaucucucuuccccuuaugccuguccacgaccucccaaaaaacaacguggcuuccggugcuauugggaucucuuggauguaaaccacuaaccauguuucuuauaacagaaaccaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggugguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaaacaucacaagaagggccccuaccagagauugaagaugagguguuuaggaaaagaaacuuaacaauaauggaccuacauccaggaucggggaaaacaagaagauaucucccagccauaguccgugaagccauaaaaaggaagcugcgcacacuaauuuuggcucccacaaggguugucgcuuccgaaauggcagaggcgcuuaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacgacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcggccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggaggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaaugguaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaauccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaagggguacucugguga

SEQ ID NO: 5955 - RNA, 9879 nt, Artificial Sequence
  derived and/or modified CDS sequence (wt) from DENV-1__FJ898417__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacaucuaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucucacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugacgguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauccaauugagcagaaaaacuuuugauacagaguaccaaaaaacaaaaaacaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagcuuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccgauccaguugauugggucccaaccagccgcaccaccuggucgauccaugcccaucaccaauggaugacaacagaagacaugcugucaguguggaauaggguuuggauagaggaaaacccauggauggaggacaaaacccacauaucuaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 5956 - RNA, 9879 nt, Artificial Sequence
  derived and/or modified CDS sequence (wt) from DENV-1__GQ868612__SS-prME
ucugugaccaugcuccuuaugcugaugccuacagccuuggcauuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagccaugguucaggcagauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucucucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagaggggcugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5957 - RNA, 9879 nt, Artificial Sequence
  derived and/or modified CDS sequence (wt) from DENV-1__FJ898419__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccccaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguucgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauccaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggauggacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 5958 - RNA, 9879 nt, Artificial Sequence
  derived and/or modified CDS sequence (wt) from DENV-1__FJ898420__SS-prME
ucugugaccaugcuccuuaugcugaugccuacagccuuggcauuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagccaugguucaggcagauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcagguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagaggggcugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaagagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5959 - RNA, 9879 nt, Artificial Sequence
  derived and/or modified CDS sequence (wt) from DENV-1__FJ898421__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcagauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaagcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggauaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaguuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagaguggucccgaaggggcacucugguga

SEQ ID NO: 5960 - RNA, 9879 nt, Artificial Sequence
  derived and/or modified CDS sequence (wt) from DENV-1__FJ898423__SS-prME
ucugugaccaugcuccuuaugcugaugccuacagccuuggcauuccauuugacuacacgaggaggagagccgcacaugauaguuagcaagcaggaaagaggaaagucacuuuuguucaaaaccucagcaggugucaacaugugcacccucauagcgauggauuugggagaguuaugugaggacacaaugacuuacaaauguccucgaauuacugagguggaaccagaugacguugauuguuggugcaacaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcccugagacacccaggauucacggugauagcccuuuuucuagcacaugccauaggaacauccaucacccagaaagggauuauuuucauucuguuaaugcugguaacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaauucaauaugaaaauuugaaauauucaguaauagucaccguccacacuggagaccagcaccaggugggaaaugaaagcacagaacaugggacaauugcaacuauaacaccucaagcuccuacgucggaaauacagcugaccgacuacggagcucuuacauuggacugcucaccuagaacaggacuggacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgaccggaacgacaacaauuuuugcaggacaccugaaauguagacuaaagauggacaaacugacucuaaaagggaugucauaugugaugugcacagguucauucaagcuagagaaagaaguggcugagacccagcauggaaccguucuagugcagauuaaauacgaaggaacagaugcaccaugcaagaucccuuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaauaacacuauaccuaggagucaugguucaggcggauucaggauguguaauuaauuggaaggguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugguuaggccacaacccauggaacacaaauacucguggaaaagcuggggaaaagccaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauuacgugacuccuacacccaaguaugugaccaccggcuaaugucagcugccaucaaggacagcaaggcaguucacgcugauaugggguacuggauagaaagugaaaagaaugagaccuggaaguuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggauguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacauuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacguggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcacuuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaccaguacaucuacaugggacagccuuuaaacaacgaugaagaucacgcccacuggacagaagcaaaaaugcuccuugauaauauaaacacaccagaagggaucaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaaaaaacuacgaccccgcuggcuagaugccagaacauacucagacccacuggcccugcgcgaguuuaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggaccccgugguuuaugaugcaaaauuugagaaacaauuaggccaaauaauguuguugauacuaugcacaucacagauccuuuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaagaaggaagaacguuacgcguccuaaagaugguggaaccauggcucagaggaaaccaauucugcauaaagauucugaaucccuacaugccaagugugguggaaacccuggaacauaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacaccacacccuuuggacaacagaggguguuuaaagagaaaguugacacacgcacaccaaaagcaaaacgaggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugagcgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaauauggcgucgaaaggcuaaaaagaauggcaaucagcggagaugacugcguggugaaaccaauugaugacagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5961 - RNA, 9879 nt, Artificial Sequence
  derived and/or modified CDS sequence (wt) from DENV-1__FJ898424__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucaacagguguuaacaugugcacccucauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaaugguuguggacucuucggaaaaggaagucugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguuuuagugcagauuaaauacgaaggaacagaugcaccaugcaagauccccuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucauggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugagguuucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuguccuacaaaguugccucagaaggcuuccaguacuccgauagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauauuagagauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaauauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugucuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5962 - RNA, 9879 nt, Artificial Sequence
  derived and/or modified CDS sequence (wt) from DENV-1__FJ898425__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcaauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggccgagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuauuggaaaacuaguacaccagauuuuuggaacugcauauggaguuuuguucagcgguguuuccuggacuaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagggagcucaaauguggaaguggcauuuuugucacuaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagaugugcagaacaccaccuucaucaucgacggcccaaacaccccagaaugcccugaugaucaaagagcauggaacauuugggaaguugaggacuauggauuuggaauuuucacgacaaauauaugguugaaaaugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucauccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaauuauggcuguuggaguagucagcauccuacuaaguucacuucucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuagacaaccuggucauguugcacaacuccgaacaaggaggaagagccuauagacaugcaauggaagaauugccagacaccauagaaacguugaugcuccuagcuuugauagccguguugacugguggagugacgcuguucuuccuaucaggaaggggccuagggaaaacaucuaucggcuuacucugcgugauggcuucaagcguacugcuauggauggccaguguggaaccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucucgccuugggaugcuauucacaggugaauccacugacgcugacagcggcgguauugaugcuaguggcucacuacgccauaauuggaccuggauugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccauuacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugacauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaaaagacguggaccuaggcgcuggaacuagacauguggcaguggaaccagaaguagccaaccuggauaucauuggccagaggauagagaacauaaaacaugagcacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagugcaaaucauggaggugacagccagaugguuaugggguuuucuuuccagaaacaaaaaaccaagaauuugcacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagcgagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaacauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaacugugauggaugucauauccagacgugaccaaagaggaaguggccaggucggaacuuauggcuugaacacuuucaccaacauggaagcccagcuaauaagacaaauggagucugagggaaucuuuuuacccagcgaauuggagaccccaaauuuagccgagaggguucuugacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5963 - RNA, 9879 nt, Artificial Sequence
  derived and/or modified CDS sequence (wt) from DENV-1__FJ898426__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucgcaaacccugccguccugcguaaacugugcauugaagccaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuaucggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuagcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaauaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaagacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacaccuuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaauauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5964 - RNA, 9879 nt, Artificial Sequence
  derived and/or modified CDS sequence (wt) from DENV-1__GQ199856__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuguagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcguauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaauaggacaauugacauggaaugacuugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauucaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguauccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaauuuugugaaaccagaagggaaagucauagaccucgguuguggaagagguggcuggucauacuauugcgccgggcugaagaaagucacagaagugaagggauauacgaaaggaggaccuggacaugaagagccaauuccaauggcgaccuauggauggaaccuaguaaaacugcacuccgggaaagacguguucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcgaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaaguuaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagauuauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5965 - RNA, 9879 nt, Artificial Sequence
  derived and/or modified CDS sequence (wt) from DENV-1__FJ898427__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuagccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaggauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuacccugcuguccuugacauuuauuaaaacaacgcuuuccuuacacugugcauggaagacaauggcuaugguauugucaauugcaucucucuuccccuuaugccuguccacgaccucccaaaaaacaacguggcuuccggugcuauugggaucucuuggaugcaaaccacuaaccauguuucuuauaacagaaaccaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggugguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaagccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacgacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcggccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggaggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaauccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5966 - RNA, 9879 nt, Artificial Sequence
  derived and/or modified CDS sequence (wt) from DENV-1__JF937599__SS-prME
ucugugaccaugcuccuuaugcugaugccuacagccuuggcguuccauuugacugcacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggaaacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaguccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuagguuuaaacucaaggagcacgucccuuucgaugacgugcauugcaguuggccuaguaacauuauaccuaggagucaugguucaggcggauucaggaugugugauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagaggcuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacguuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugauagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagccagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugagguuaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugcuacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5967 - RNA, 9879 nt, Artificial Sequence
  derived and/or modified CDS sequence (wt) from DENV-1__FJ898431__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaacagaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccuccuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcugugcucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacaacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccuuaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacuccuccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaagcuuccacaacacuugacgcaaagggcccagaacgccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacguugacagcggcgguguugaugcuaguggcucauuacgccauaauuggaccuggacugcaagcaaaagcuacuagagaagcucaaaaaaggacagcggccggaauaaugaagaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaccuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucaucuauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguuuacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaagagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaaguuagaagacuaauugggaaugagaauuauuuagauuacaugacaucaaugaagagauucaagaacgagagugauccugaaggggcacucugguga

SEQ ID NO: 5968 - RNA, 9879 nt, Artificial Sequence
  derived and/or modified CDS sequence (wt) from DENV-1__GU131678__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguagagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugucgacgaacguuuguggacagaggcuggggcaauggcugugggcucuucggaaaaggaagccuacuaacgugugcuaaguucaaguguaugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucgacaucacaagagacuuggaauagacaagauuugcuggugacauuuaagacagcucaugcaaagaagcaggaaguagucguauuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaacauugaggcagaaccgccuuuuggugagaguuacaucgugauaggagcaggugaaaaagcuuugaaacuaagcugguucaagaaaggaaguagcauagggaaaauguuuaaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauccauggaggaccaauaucucagcacaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuuuacuaggacugcuaugcauaucaauaaugaucgaagaggugaugagauccagauggaguaggaaaaugcugaugacuggaacacuggcuguguucuuccuucucauaaugggacaguugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacacuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgagauggcagaagcgcucaagggaaugccaauaagguaccaaacaacagcagugaagagugaacacacaggaaaagagauaguugaccucaugugucacgcuacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagaguaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacagacaucuccgaaaugggagcaaauuuccgggccgacagggugauagacccaagacggugucugaaaccgguaauauuaaaagaugguccagagcgugucauuuuggcaggaccgaugccagugacuguggccagugccgcccagaggagaggaagaauuggaaggaaccccaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccggagagagaaaagagugcagcaauagacggggaauauagacugcggggugaagcaaggaaaacguuuguggagcucaugagaagaggagaccuaccugucuggcuguccuacaaaguugccucagaaggcuuccaguacucugacagaagauggugcuuugccggggaaaggaacaaccagguguuggaggagaacauggacguggagaucuggacaaaagaaggagaaagaaagaaacuauuaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggaugggcaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugccaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugugaauccaucacacuggccacuggaccucugaccacgcuuugggagggaucuccaggaaaauuuuggaacaccacgauagcgguuuccauggcaaacauuuuuagaggaaguuaucuagcaggagcagguuuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggccugaaaagaggagaaacaaccaaacaugcagugucgagaggacccgcuaaacugaggugguuuguggagaggacccuugugaacccagaagggaaagucauagcccuugguuguggaagaggugccuggucauacuauugcgcugggcugaagaaaggcacagaagugaagggauauacaaaaggaggaccuggacaugaggaaccaaucccaauggcgaccuauggaugggaccuaguaaaacugcacuccgggaaagacguauucuucauaccaccugagaaaugugauacccuuuugugugauauuggugaguccucuccaaacccaacuauagaggaaggaagaacccuacgcguucuaaagaugguggaaccauggcucagaggaaaccaauuuugcauaaagauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggacccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugucccacguguguuuacaacaugauggggaagagagaaaaaaaacuaggagaguucggaaaggcaaaaggaagccguccaauaugguacaugugguugggagcacgcuuucuagaguuugaagcucuugguuucaugaacgaagaucacugguucagcagagagaauucacucagcggaguggaaggggaagcacuucacaaacuuggauauauacucagagacauaucaaagauuccagggggaaacauguaugcagaugacacagccggaugggauacaaggauaacagaggaugaccuccagaaugagggcaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaauuuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggacccugagagaaacugcaugccuaggcaagucauaugcacaaauguggcagcugauguacuuccccaggagagcccugagacuagccgcuaaugcuaucuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacaccaagggccaccuggcccaccaacauacaaguggccauaaaccaagugagaagacuaauugggaaugagaauuauucagauuacaugacaucaaugaagagauucaagaacgagagugaacccgaaggggcacucugguga

SEQ ID NO: 5969 - RNA, 9879 nt, Artificial Sequence
  derived and/or modified CDS sequence (wt) from DENV-1__GU131679__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuuaggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcaaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaagcauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauaccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaucagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucauggaaaagcuggggaaaggcuaaaaucauaggggcagaugugcagaaugccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaauggguauuaugauuuuaaaauuauugacugacuuucaaucacaucaguugugggcuaccuugcuguccuugacauuuaucaaaacaacguuuuccuugcauuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacaugcuaaccauucuccugaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuucugucucccgugagaguucccaauuacaacaugauuaucauggaugaagcacauuucaccgauccauccagcauagcggccagaggguacaucucaacccgaguggguaugggugaagcagcugcuaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaauaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucagggaggggccuagggaaaacaucuaucggccuacucugugugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagaauuggaucccgugguuuaugauacaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcggucuccauggcaaacauuuuuagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacuuuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuagguaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagauugauccugaaggggcacucugguga

SEQ ID NO: 5970 - RNA, 9879 nt, Artificial Sequence
  derived and/or modified CDS sequence (wt) from DENV-1__GU131680__SS-prME
ucugugaccaugcuccuuaugcugaugccuacagcccuggcguuccauuugacuacacgagggggagagccgcacaugguagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguggagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucgacaucacaagagacuuggaauagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauccauggaggaccaauaucucagcacaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaguugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacacuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgagauggcagaagcgcucaagggaaugccaauaagguaccaaacaacagcagugaagagugaacacacaggaaaagagauaguugaccucaugugucacgcuacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagaguaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacagacaucuccgaaaugggagcaaauuuccgggccgacagggugauagacccaagacggugucugaaaccgguaauauuaaaagaugguccagagcgugucauuuuggcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccggagagagaaaagagugcagcaauagacggggaauauagacugcggggugaagcaaggaaaacguuuguggagcucaugagaagaggagaccuaccugucuggcuguccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggauggccaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugugaauccaucacacuggccacuggaccucugaccacgcuuugggagggaucuccaggaaaauuuuggaacaccacgauagcgguuuccauggcaaacauuuuuagaggaaguuaucuagcaggagcagguuuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuucauaccaccugagaaaugugauacccuuuugugugauauuggugaguccucuccaaacccaacuauagaggaaggaagaacgcuacgcguucuaaagaugguggaaccauggcucagaggaaaccaauuuugcauaaagauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggggaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaauuuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 5971 - RNA, 9879 nt, Artificial Sequence
  derived and/or modified CDS sequence (wt) from DENV-1__GU131681__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggauacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuucaaugaaaugguguuguugacaaugaaagaaaaaucauggcuaguccacaaacaaugguuucuagaccuaccacugcccuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguuccauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaucggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucaacacaacuacagaccaggauauuucacacaaacggcagggccguggcaccuagguaaguuggaacuggauuuugauuugugugaggguaccacaguuguuguagaugaacauuguggaaaucgaggaccaucucuuagaaccacaacagucacaggaaagauaauucaugaaugguguugcagaucuugcacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaguguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucucacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuaucaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagccguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcaccgggcaccuucaagaccccugaaggugaaguuggagccauugcccuagauuuuaaacccggcacaucuggaucucccauagugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcuccuacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaggcagcugcgaucuucaugacagccacucccccaggaucaguggaggccuuuccacagagcaaugcaguuauccaagaugaggaaagagacaucccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccaaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuccgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacacuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgcgaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuugcacaagagaggaguucacaagaaaagucaggucaaacgcagccauuggagcgguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuuggauucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacaugggagcccagcuaauaagacaaauggagucugagggaaucuuuucacccagcgaauuggagaucccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggcaaccugggccucuaacauacaaguggccauaaaccaagugagaagacuaauugggaaugagaauuaucuagauuacaugacaucaaugaagagauucaagaacgagggugaucccgaaggggcacucugguga

SEQ ID NO: 5972 - RNA, 9879 nt, Artificial Sequence
  derived and/or modified CDS sequence (wt) from DENV-1__GU131682__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugacuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguuaacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacaucuggaacgacaacaauuuuugcaggacacuugaagugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuucuuggaccaugaaaauaggaauagggguucugcugacauggcugggauuaaacucaaggagcacgucccuuucgaugacgugcauugcaguuggccuaguaacacuauaccuaggaguuaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagggcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccuaaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacauccggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcucugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuucuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5973 - RNA, 9879 nt, Artificial Sequence
  derived and/or modified CDS sequence (wt) from DENV-1__GU131683__SS-prME
ucugugaccaugcuccuuaugcugaugccuacagccuuggcguuccauuugacuacacgagggggagagccgcacaugauagucagcaagcaggaaagaggaaagucacucuuguuuaagaccccagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuuggcuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaaguuacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuagcccacaaacaaugguuuuuagaccuaccacugccuuggaccucgggagcuucaacaucacaagagacuuggaacagacaagaucugcuggugacguuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagauccccuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucugcuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauauaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccuuuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucacuaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcgaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuacgcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagcugagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5974 - RNA, 9879 nt, Artificial Sequence
  derived and/or modified CDS sequence (wt) from DENV-1__GU131684__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcuauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaaaaaaaugauuaggccacaacccauggaguacaaauacucguggaaaagcuggggaaaagcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaggaugggugcugguacgguauggaaaucagaccagucaaggaaaaggaagagaaucuagucaaaucaaaggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagccguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccaggggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcccacuggacagaagcaaaaaugcuccuugauaauauaaacacaccagaaggaauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaagggggcuagggaaaacauccaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaaccauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccuccugaugcggacuacaugggcccugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacgacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5975 - RNA, 9879 nt, Artificial Sequence
  derived and/or modified CDS sequence (wt) from DENV-1__GU131685__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuuuggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggaaaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugguaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcugggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcggaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5976 - RNA, 9879 nt, Artificial Sequence
  derived and/or modified CDS sequence (wt) from DENV-1__GQ868614__SS-prME
ucugugaccaugcugcucaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguagauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaaaugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcccauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggagcugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagucacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacacaaccuucaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccgguuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggagagugaaaugguaauuccaaaaaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaacgaugugccgcuagcugggccacugauagcuggaggcaugcuaauagcauguuauguuauaucuggaagcucagcugacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaggaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagguccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacucgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggauguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggacccggacaugaggaaccaaucccaauggcgaccuauggauggaaccuaguaaaacugcacuccgggaaagacguauucuuuacaccaccugagaaaugugacacacuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaccgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaauuuguacaagagaggaguucacaaggaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuaccgacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaaugagggugaucccgaaggggcacucugguga

SEQ ID NO: 5977 - RNA, 9879 nt, Artificial Sequence
  derived and/or modified CDS sequence (wt) from DENV-1__GU131688__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacagacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaaugacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucugucggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggcuacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauccaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggcgaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagggaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggguggaaccuaguaaaacugcacuccgggaaagacguauucuuuauaccacccgagaaaugugacacccuuuugugugauauuggugaguccucuccaaacccaacuauagaggaaggaagaacgcuacgcguccuuaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcagcagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 5978 - RNA, 9879 nt, Artificial Sequence
  derived and/or modified CDS sequence (wt) from DENV-1__GU131689__SS-prME
ucugugaccauguuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaaucucaaacaccaccacagacucaagauguccaacacaaggagaagccacacugguggaagaacaagacgcgaacuuugugugucgacgaacguuuguggacagaggcuggggcaauggaugugggcucuucggaaaaggaagccuaauaacgugugccaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuaguacagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacaucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacaugugucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacacuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccaugaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugaucaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagauaucuccgaaaugggagcaaauuuccgggccgacagggugauagacccaagacggugucugaaaccgguaauacuaaaagaugguccagagcgugucauuuuagcaggaccgaugccagugacuguagccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaauuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugauguuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgaggggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagaggaagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggauguuauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggcuauaaaccaagugagaagacuacuugggaaugagaauuaucuagauuacaugacaucaaugaagagauucaagaaugagagugauccugaaggggcacucugguga

SEQ ID NO: 5979 - RNA, 9879 nt, Artificial Sequence
  derived and/or modified CDS sequence (wt) from DENV-1__GU131690__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaagcaugggaggaggguguguguggaauucgaucaguaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauagugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaguuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaagaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccucauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugauguuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguucaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaguauggcgucgaaaggcugaaaagaauggcaaucagcggagaugacugcguggugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5980 - RNA, 9879 nt, Artificial Sequence
  derived and/or modified CDS sequence (wt) from DENV-1__GU131695__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuuuggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccacccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacaccuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugguaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauugcggaaaucgaggaccaucucuuaggaccacaacagucacagggaagauaauucaugaaugguguugcagaacuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucucauagcggaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcaccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggaaggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucacuaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcccugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5981 - RNA, 9879 nt, Artificial Sequence
  derived and/or modified CDS sequence (wt) from DENV-1__GU131697__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccaguaccaggugggaaaugaaagcacagaacaugggacaacugcaacuauaacaccucaagcuccuacgacggaaauacagcuaaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacaaacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcaugggaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguucugcugacauggcuaggauuaaacucaaggagcacgucccucucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuucgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaauauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggccaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaacaacgacugggacuacgucgucacaacagacaucuccgaaaugggagcgaauuuccgggcugacagggugauagacccaagacggugucugaaaccgguaauacuaaaggaugguccagagcgugucauuuuagcaggaccgaugccagugacuguggccagugccgcccagaggagaggaagaauuggaaggaaccacaacaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuacucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucccuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugagaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguuuugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcggaugacacagccggaugggauacaaggauaacagaggaugaccuucagaaugaggccaaaauuacugacaucauggaacccgaacacgcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaagggauggaaugauuggcagcaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacagaagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5982 - RNA, 9879 nt, Artificial Sequence
  derived and/or modified CDS sequence (wt) from DENV-1__GU131700__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaagaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucauuaucgacggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuguuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaaguucagccgaccuaucacuagagaaagcagcugaggucuccugggaagaagaagcagaacacucuggugccucacacaacauauuaguagagguccaagaugauggaaccaugaagauaaaggaugaagagagagaugacacgcuaaccauucuccuuaaagcaacucugcuaacagucucagggguguacccauuaucaauaccagcgacccuuuuugugugguacuuuuggcagaaaaagaaacagagaucuggaguguuaugggacacaccuagcccuccaaaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuugacaauaauggaccuacauccaggaucggggaaaacaagaagauaucuuccagccauaguccgugaggccauaaaaaggaagcugcgcacauuaauucuggcuccuacaagaguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguauaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaucagguguuggaggagaacauggacguggagaucuggacaaaagaaggagaaagaaagaaacuaagaccccgcuggcuggaugcuagaacguacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgaugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccuaacagccauugcaaaccaggcggcuauauugaugggacuugacaaaggauggccaauaucgaagauggacauaggaguuccacuucucgccuuagggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauaguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagcccggagaguucuugacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccaguugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaucaagugagaagacuaauugggaaugagaauuaucuagauuacaugacaucaaugaagagauucaagaacgagagugauccugaaggugcacucugguga

SEQ ID NO: 5983 - RNA, 9879 nt, Artificial Sequence
  derived and/or modified CDS sequence (wt) from DENV-1__GU131701__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugacagcccuuuuucuagcacaugucauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaagugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccacaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuucuuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaaccacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccaccuuuaaaaugagaccgauguuugcuguagggcuauuauuucgcagacuaacauccagagaaguucuucuucuaacaauuggauugagucuaguggcaucuguggagcuaccaaauuccuuggaggagcugggggauggacuugcaaugggcauuaugauuuuaaaauuauugacugacuuucaaccacaucaacugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaagcuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacauccggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaucaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagcgccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggugaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcucugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccggagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccaucgcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacgcauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaauaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacagacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccaggaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacuuugguga

SEQ ID NO: 5984 - RNA, 9879 nt, Artificial Sequence
  derived and/or modified CDS sequence (wt) from DENV-1__GU131703__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacuccugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucucauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccucaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacaacgccgggcacuuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguuuuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuggggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagcggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5985 - RNA, 9879 nt, Artificial Sequence
  derived and/or modified CDS sequence (wt) from DENV-1__GU131706__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacauuguaauaggagcaggugaaaaagcuuugaaacuaagcugguucaggaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaaugacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauuaggaucccuuggaugcaaaccacuaaccauguuucuuauagcagaaaacaaaaucuggggaaggagaaguuggccccucaaugaaggaaucauggcuguuggaauagucagcauccuacuaaguucacuccuuaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaucaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuaccagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaguggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuuguauaaaaauucugaaucccuacaugccaagugugguggaaacucuggagcaaaugcagagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauacaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaucugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5986 - RNA, 9879 nt, Artificial Sequence
  derived and/or modified CDS sequence (wt) from DENV-1__GU131708__SS-prME
ucugugaccaugcuccuuaugcugaugccuacagccuuggcguuccauuugacuacacgagggggagagccgcacaugguagucagcaagcaggaaagaggaaaaucacucuuguucaagaccucagcaggugucaacaugugcacccuuauagcgauggauuugggagaguuaugugaggacacaaugacuuacaaaugcccucgaaucacugaagcugaaccagaugacguugacuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagaccuggaacagacaagauuugcuggugacauuuaagacagcucaugcaaagaagcaggaaguagucgugcuaggaucacaagaaggagcaaugcacacugcguugaccggagcaacagaaauccaaacgucaggaacgacaacaauuuuugcaggacacuugaaaugcagacuaaagauggacaaacugacucuaaaagggaugucauaugugaugugcacaagcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggauuagggguucugcugacauggcuaggauuaaacucaaggagcacgucccuuucgaugacgugcauugcaguuggccuaguaacacuauacuuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacgucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucaugggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacagacuuucaaucacaucagcugugggccaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauccuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccccuaccagagauugaagacgagguguuuaggaaaagaaacuugacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccuauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaaguauuaaaucaggaaaugacauagccaacugccuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacgaaagagggagaaagaaagaaacuacgaccccgcuggcuggaugccagaacauacucagacccacuagcccugcgcgaguucaaagaguuugcagcagggagaagaagcgucucaggugaucuaauauuagaaauagggaaacuuccacaacacuugacgcaaagggcccagaaugcccuggacaaccugguuauguugcacaacuccgaacaaggaggaagagccuacagacaugcaauggaagaacugccagacaccauagaaacguugaugcuccuagcuuugauagcuguguuaacugguggagugacacuguucuucuuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccaugcggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccccugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacaguugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaagugagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacauguugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5987 - RNA, 9879 nt, Artificial Sequence
  derived and/or modified CDS sequence (wt) from DENV-1__GU131710__SS-prME
ucugugaccaugcuccuuaugcugaugccuacagccuuggcguuccauuugacuacacgagggggagagccgcacaugauagccagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuagccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaucuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaauaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccauugggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaagcuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagagaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucacugacccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugcugcaaugcuggacguagacuuacauccagcuucagccuggacccucuaugcaguggccacaacaauuaucacucccaugaugaggcacacaaucgaaaacacaacggcaaacauuucccugacagccauugcaaaucaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucggcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagacuacaugacaucaaugaagagauucaagaacgagagugaucccgaaggggcacucugguga

SEQ ID NO: 5988 - RNA, 9879 nt, Artificial Sequence
  derived and/or modified CDS sequence (wt) from DENV-1__GU131717__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacagacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaaugacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaaacuuugaaacuaagcugguucaagaaaggaagcagcauagggaaaauguuugaggcaacugccagaggagcacgaaggauggccauacugggagacaccgcaugggacuuugguucuauaggaggaguguucacgucugucggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggcuacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccugcuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucaugcaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauccaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggcgaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgcagggcugaagaaagucacagaagugaagggauauacgaaaggaggaccuggacaugaggagccaauuccaauggcgaccuauggguggaaccuaguaaaacugcacuccgggaaagacguauucuuuauaccacccgagaaaugugacacccuuuugugugauauuggugaguccucuccaaacccaacuauagaggaaggaagaacgcuacgcguccuuaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcagcagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 5989 - RNA, 9879 nt, Artificial Sequence
  derived and/or modified CDS sequence (wt) from DENV-1__GU131718__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcaauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcauagaacaugggacaacugcaacuauaacaccucaagcucccacgucagaaauacagcugaccgacuacggagcucuuacauuggauugcucacccagaacaggauuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggccgagacccagcauggaaccguuuuagugcagauuaaauacgaaggaacagaugcaccaugcaagaucccuuuuucgacccaagaugaaaaaggaguaacccagaaugggagacugauaacagcuaauccuauagucauugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuauuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagggagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagaugugcagaacaccaccuucaucaucgacggcccaaacaccccagaaugcccugaugaucaaagagcauggaacauuugggaaguugaggacuauggauuuggaauuuucacgacaaauauaugguugaaaaugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguaggaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaagagcugggagauggacuugcaaugggcauuaugauuuuaaaauuauugacugacuuucagucacaucagcugugggcuacauugcuguccuugacauuuauuaaaacaacgcuuuccuuacacuaugcauggaagacaauggcuaugguacugucaauuguaucucucauccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaauuauggcuguuggaguagucagcauccuacuaaguucacuucuaaaaaaugaugugccgcuagcugggccacuaauagcuggaggcaugcuaauagcauguuaugucauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucucgaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuucugaaauggcagaggcgcucaagggaaugccaauaagguaccaaacaacagcagugaagagugaacacacaggaaaagagauaguugaccucaugugccacgccacuuucaccaugcgucuccugucccccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugauauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggaucaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgauggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagccguguugacugguggagugacgcuguucuuccuaucaggaaggggccuagggaaaacaucuaucggcuuacucugcgugauggcuucaagcguacugcuauggauggccaguguggaaccccauuggauagcggccuccaucauacuggaguucuuccuaauggugcugcuuauuccagagccagacagacaacgcacuccgcaggacaaucagcuagcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucucugacagcuauugcaaaccaggcagccauauugaugggacuugacaaaggauggccaauaucgaagauggacauaggaguuccacuucucgccuugggaugcuauucacaggugaauccacugacgcugacagcggcgguauugaugcuaguggcucacuacgccauaauuggaccuggauugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccauuacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccucuugugugacauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaaaagacguggaccuaggcgcuggaacuagacauguggcaguggaaccagaaguagccaaccuggauaucauuggccagaggauagagaacauaaaacaugagcacaagucaacauggcauuaugaugaggacaauccauacaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagugcaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugaaaaaagagagggagcuucacaaacagggaaaaugugccacguguguuuacaacaugauggggaagcgagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaacauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaacugugauggaugucauauccagacgugaccaaagaggaaguggccaggucggaacuuauggcuugaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaaggaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguuaucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5990 - RNA, 9879 nt, Artificial Sequence
  derived and/or modified CDS sequence (wt) from DENV-1__GU131720__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggaucauuuucauuuuguuaaugcugguaacaccauccauggccaugcgaugcgugggaauaggcagcagggacuucguggaaggacugucaggagcaacuuggguagacguaguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucaugguuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucggucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucgcgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucuuuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuggcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguucaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagcuacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucguuacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauauuggaguucuuccuaauggugcugcuuauuccagagccagacaggcaacgcacuccgcaggacaaucagcuggcguauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguagauggaauuguugcaauagauuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccaaaauuacugacaucaugaagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaauugauuggguuccaaccagucgcaccaccuggucgauccaugcccaccaccaauggaugacaacagaagacauguugucaguauggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5991 - RNA, 9879 nt, Artificial Sequence
  derived and/or modified CDS sequence (wt) from DENV-1__HM181960__SS-prME
ucugugaccaugcuccuuaugcugaugccuacagccuuggcguuccacuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuuguuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguacuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggcuauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgccucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagacgggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcucuagacuuuaaaccuggcacaucuggaucucccaucgugaacagagaaggaaaaauaguaggucucuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcaguaaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuugucccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaacauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugcccuggacaaccugguuauguugcacaauuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcgugcugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagcuuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggagugggauuauggaaguggacagauccgaagccaaagagggauugaaaagaggagaaacaaccaaacaugcagugucgagaggaaccgcuaaacugaggugguuuguggagaggaaccuugugaaaccagaagggagagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggcugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucaccuagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagauaugcugucaguguggaacaggguuuggauagaggaaaacccauggauggaggacaaaacccacauauccaguuggggagauguuccauacuuaggaaaaagggaagaccaaugguguggaucccugauaggcuuaacagcaagggccaccugggccaccaauauacaaguggccauaaaccaagugagaagacuaauugggaaugagaauuaucuagauuacaugacaucaaugaagagauucaagaacgagagugaucccgaaggggcacucugguga

SEQ ID NO: 5992 - RNA, 9879 nt, Artificial Sequence
  derived and/or modified CDS sequence (wt) from DENV-1__HM181963__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcuauggauuugggagaguuuugugaggacacaaugacuuacaagugcccucgaaucacugaggcggaaccagaugacguugauuguuggugcaaugccacagacacaugggugaccuauggaacauguucccaaauuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacauugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacaacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauagucacugacaaagagaaaccagucaacauugaggcagaaccgccuuuuggugagaguuacaucgugauaggaguaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguucuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaguacaaauacucguggaaaagcuggggaaaagcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaacggaguucuggaaagugaaaugauaauuccgaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuccucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccaugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguucaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaguaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccggccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccaggggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacgguguuugaaaccgguaauacuaaaagaugguccagagcgugucauuuuagcaggaccgaugccagugacuguggccagugccgcccagaggagaggaagaauuggaaggaaccauaauaaggaaggugaccaguacaucuacaugggacagccuuuaaacaacgaugaagaucaugcucacuggacagaagcaaaaaugcuccuugauaauauaaacacaccagaaggaauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagcuuauagacaugcaauggaagaacugccagacaccauagaaacguugaugcuccuagcuuugauagcuguguuaacugguggagugacgcuguucuuccuaucaggaagggggcuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaaccauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggcccugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagagcucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5993 - RNA, 9879 nt, Artificial Sequence
  derived and/or modified CDS sequence (wt) from DENV-1__HM181964__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauugcugguguaaugccacagacacaugggugaccuauggaacauguucccaaacuggugagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaccugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacugcgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagagaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuucccacugagcaacgcaguuauccaagaugaggaaagagacauuccugagagaucauggaacucaggcuaugaguggaucacugauuucccagguaaaacaguuugguuuguuccaagcauuaaaucaggaaaugacauugccaacuguuuaagaaagaaugggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacacuauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacaaacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccuuuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguuaggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugauacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5994 - RNA, 9879 nt, Artificial Sequence
  derived and/or modified CDS sequence (wt) from DENV-1__HM181966__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucaguaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccguugcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcgacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacucauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauacucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccuagaugaaaaaggaguaacccagaaugggagauugauaacagcuaauccuauagucacugacaaagaaaaaccagucaauauugaggcagaaccgccuuuuggugagaguuacaucgugauaggagcaggugaaaaagcuuugaaacuaagcugguuuaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauacggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauauaaauuucaagcugacuccccaaagagacuaucagcagccaucgggaaggcaugggaggaggguguguguggaauucgaucagccacucgucucgagaauauuauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagccaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaacuacagaccaggauauuucacacaaacggcagggccguggcaucuaggcaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggagcaggaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauagccaccuuuaaaaugagaccaauguuugcugucgggcuacuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuuuacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccacuaucaauaccagcgacccuuuuugugugguacuuuuggcagaaaaagaaacagagaucuggagugcuaugggauacaccuagcccuccaaaaguggaaagagcaguucuugaugaugguaucuauagaaucaugcagagaggacuguugggcaggucccaaguaggaguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuucaagaccucugaaggugaaguuggagccauugcccuagauuuuaaacccggcacaucuggaucucccaucgugaacagagaaggaaaaauaguaggucuuuauggaaauggaguggugacaacaagugggaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggauuacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucaugcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcugugcugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaucaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugagaacuacaugggccuugugcgaauccaucacacuggccacuggaccucugaccacgcuuugggaggggucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuauaugccaagugugguggaaacucuggagcaaaugcaaagaaaacauggaggaaugcuaguacgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaacggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugcccuuuuguucacaccacuuccaccagcugguaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagcuguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacugauugggaaugagaauuaucuagauuacaugacaucaaugaagagauucaagaacgagggcgaucccgaaggggcacucugguga

SEQ ID NO: 5995 - RNA, 9879 nt, Artificial Sequence
  derived and/or modified CDS sequence (wt) from DENV-1__GU131721__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuuuuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaauggugcuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaggaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucugcuggaaaauuaguacaccagauuuuuggaacugcauauggaguuuuauucagcgguguuuccuggaccaugaaaauaggaauagggguuuugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauauaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugauaugggguacuggauagaaagugaaaagaacgagaccuggaagcuggcaagagccucuuucauagaaguuaaaacauguaucuggccaaaaucccacacucuauggagcaauggaguucuggaaagugaaaugauaguuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaauaaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucacaucagcugugggcuaccuugcuauccuugacauuuaucaagacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggggcuguacucauguaucaagggaagagauuggaaccgagcugggccaguguuaaaaaagaccugaucucauauggaggagguuggaggcuucaaggauccuggaacacaggagaagaagugcaggugauugcuguugaaccggggaaaaaccccaaaaauguacaaacagcgccgggcacuuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaggcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucggacccacuagcccugcgcgaguuuaaagaguuugcagcagggagaagaagcgucucaggugauuuaauauuagaaauagggaagcuuccacaacacuugacgcaaagggcccagaaugccuuggacaaccuggucauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacguccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaacuaagcaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcggaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggucagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucauaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggccuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaacccgaaggggcacucugguga

SEQ ID NO: 5996 - RNA, 9879 nt, Artificial Sequence
  derived and/or modified CDS sequence (wt) from DENV-1__GU131723__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauagugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaguuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagccccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaguuggaaggaaccacaauaaagaaggugaucaguacaucuacaugggacagccuuuaaauaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaguggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaguauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggcuaccaacauacaaguggccauaaaccaagugagaagacuaauugggaaugagaauuaucuagauuacaugacaucaaugaagagauucaagaacgagagugaucccgaaggggcacucugguga

SEQ ID NO: 5997 - RNA, 9879 nt, Artificial Sequence
  derived and/or modified CDS sequence (wt) from DENV-1__GU131725__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuuuguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucacuguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuagugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcagauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaauaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuuuauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccucagacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauauuaaaauuguugacugacuuucaaucauaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaagaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagggugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguagaggccuuuccacagagcaacgcaguuauccaagaugaggaaagagacauuccugagagaucauggaacucaggcuaugaguggauuaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuugcauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcagcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuacaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccaugguuacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaagaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauagaguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5998 - RNA, 9879 nt, Artificial Sequence
  derived and/or modified CDS sequence (wt) from DENV-1__GU131726__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggaucauuuucauuuuguuaaugcugguaacaccauccauggccaugcgaugcgugggaauaggcagcagggacuucguggaaggacugucaggagcaacuuggguagacguaguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucaugguuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggagcaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucggucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucgcgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuacuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucuuuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuggcugggccacuaauagcuggaggcaugcuaauagcauguuauguuauaucuggaagcucacccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguucaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccguaagaguucccaauuacaacaugauuaucauggaugaagcacauuucaccgauccauccaguauagcagccagaggguacaucucaacccgagugggcaugggugaagcagcugcgaucuucaugacagcuacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucguuacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucaaguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauauuggaguucuuccuaauggugcugcuuauuccagagccagacaggcaacgcacuccgcaggacaaccagcuggcguauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagauuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagagguacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaauugauuggguuccaaccagucgcaccaccuggucgauccaugcccaccaccaauggaugacaacagaagacauguugucaguauggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5999 - RNA, 9879 nt, Artificial Sequence
  derived and/or modified CDS sequence (wt) from DENV-1__GU131727__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggaucauuuucauuuuguuaaugcugguaacaccauccauggccaugcgaugcgugggaauaggcagcagggacuucguggaaggacugucaggagcaacuuggguagacguaguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucaugguuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaacgggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucugucggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaauuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguaucuuauaacagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagcuauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgaguggguaugggugaagcagcugcgaucuucaugacagccacuccuccaggaucaguggaggccuuuccacaaagcaaugcaguuauccaagaugaggaaagagauauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucguuacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauuaccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacaggcaacgcacuccgcaggacaaucagcuggcguauguggugauagguuuguuauucaugauacugacaguagcagccaaugagaugggacuacuggaaacuacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagauuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgcuaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6000 - RNA, 9879 nt, Artificial Sequence
  derived and/or modified CDS sequence (wt) from DENV-1__HM631850__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccccgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuguguauugaagcuaaaauaucaaacaccaccacugauucaagauguccaacacaaggagaagccacacugguggaagaacaagacgcgaacuuugugugucgacgaacguuuguggauagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucaacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaaucuuugcaggacacuugaaauguagacuaaagauggacaagcugacucuaaaagggaugucauauguuaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagccuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacaucugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucgguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucacccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguugugggacacaccuagcccuccagaaguggaaagagcaguucuugaugaugguaucuauagaauuaugcagagaggacuguugggcaggucccaaguagggguaggaguuuuccaagaaaacguguuucacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaucccaaaaauguacaaacagcgccgggcaccuuuaagaccucugaaggugaaguuggagccauugcccuagauuucaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguauuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaucaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuaugucgucacgacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggagaucaguacaucuacaugggacagccuuuaaacaacgaugaagaucaugcucacuggacagaagcaaaaaugcuccuugauaauauaaacacaccagaagggauuauuccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaaaggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccacuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauuuuuuauaccacccgagaaaugugacacucuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaauaagaaaccgagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuugugggcagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaauuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6001 - RNA, 9879 nt, Artificial Sequence
  derived and/or modified CDS sequence (wt) from DENV-1__KF955446__SS-prME
ucugugaccauguuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaaaugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugacuugugugaggguaccacaguuguuguggaugaacauuguggaaaucgaggaccaucucuuaggaccacaacagucacaggaaagauaauucaugaaugguguugcagaucuugcacguuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaagguaucauggcuguuggaauagucagcauccuacuaaguucacuccucaaaaaugauguaccgcuagcugggccacuaauagcuggaggcaugcuaauagcauguuauguuauaucuggaagcucagcugaccuaucauuagagaaagcggcugaggucuccugggaagaagaagcagaacacucuggugccucacacaauauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuacagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccagagcaucacaagaagggccccuaccagagauugaagccgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguuggcgcuuccgaaauggcagaggcgcucaagggaaugccaauaagguaccaaacaacagcagugaagagugaacauacaggaaaagagauaguugaccucaugggucacgccacuuucaccaugggccuccuggcucccggaagaguucccaauuacaacauggucaucauggaugaagcacauuucaccgauccauccaggauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaacccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucccuggacagaagcaaaaaugcuccuugauaauauaaacacaccagaagggauuaucccagcccuuuucgagccagagagagaaaagagugcagcaauagacggggaauccagacugcggggugaagcaaggaaaacguuuguggagcucaugagaagaggagaucuaccugucuggcuauccuacaaaguugccucagaaggcuuccaguacucugacagaagauggugcuuugacggggaaaggaccaaccagguguuggaggagaacauggccguggagaucuggccaaaagaaggagaaagaaagaaacuccgaccccgcugccuggaugccagaacauacucagacccccuagcccugcgcgaguuuaaagaguuuccaccagggagaagaagcgucucaggugauuuaauauuagaaauagggaagcuuccacaccccuugacgcaaaggccccagaaugccuuggccacccugguuaugucgcacaccuccgaacaaggaggaagagccuauagacaugcaauggaagaacugccagccaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagcaacgccacucgccaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugccaaaggauggccaauaucgaagauggacauaggaguuccacuucucgccuuggggugcuauucccaggugaauccacugacgcugacagcgccgguauugaugcuagugccucauuaucccauaauuggaccuggacuccaagcaaaagcuacuagagaagcucaaaaaaggacagcggccggaauaaugaaaaauccaaccguugauggaaucguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugaccaagucagaauuuaacaccuauaaaaggagugggauuauggaaguggacagauccgaagccaaagaaggauugaaaagaggagaaacaaccaaacauccagugucgagaggaaccgcuaaacugaggugguuuguggagaggacccuugugaaaccagaagggaaagucauagaccucgguuguggaagagguggcuggucauacuauugcgcugggcugaagaaagucacagaagugaagggauauacaaaaggaggcccuggacaugaggacccaaucccaauggggaccuauggauggaaccuaguaaagcugcgcucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacauggcaagugugguggaaacucuggagcaaaugcaaagaaaacauggaggaaugcuagugcgaaauccacuuucaagaaauucuacucaugaaauguauuggguuucauggggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugagggcaagccaucaggaucagccucauccauggucaauggcggggugaaacugcucaccaaaccaugggauggcaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugggggaaucuuuucaccccgcgaauuagagaccccaaacuuagccgagagaguucucgacuggguggaaaaauauggcgucgaaaggcuggaaagaauggcaaucagcggagaugacugccuaggagaaccaauuuaugauagguuugcgacagccuugacagcucuuaaugauaugggaaaaguaagaaaagauauaccacaaugggaaccuucaaaaggauggaaugauuggcaacaagggccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauggacuuccacaggagagaccugagacuagccgcuaaugcuaucuggucagccgguccaggugauuggaucccaaccaggcguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacauggcaucuaugaagagauucaagaacgagagugaucccgaaggggcacucugguga

SEQ ID NO: 6002 - RNA, 9879 nt, Artificial Sequence
  derived and/or modified CDS sequence (wt) from DENV-1__KF921942__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaaguugcaaacccugcuguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacacugcaugggacuuugguucuauaggaggaguguucacgucugcuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacccuauaccuaggagucaugguucaggcggauucaggauguguaauaaauuggaaagguagagaacucaaauguggaaguggcauuuuugucaccaaugaaguucacacuuggacagagcaauauaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgccuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguagaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucacuaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucuccgaaaugggagcgaauuuccgagccgacagggugauagacccaagacggugucugaaaccggugauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugaucaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6003 - RNA, 9879 nt, Artificial Sequence
  derived and/or modified CDS sequence (wt) from DENV-1__JF937602__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuuggucuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguccaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuuugacccaagaugaaaaaggagugacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucuugagaacaucauguggaagcaaauaucaaaugaacugaacuacaucuuacuugaaaaugacaugaaacucacagugguuguaggagauguugcuggaaucuuggcucaagggaaaaaaaugauuaggccacaacccauggaguacaaauacucguggaaaagcuggggaaaagcuaaaaucauaggggcagaugugcagaauaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccuugacauuugucagaacaacguuuucccugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguauaucucaacccgagugggcaugggugaggcagcugcgaucuucaugacagccacuccuccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacagcacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuauuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcccacaggaaaccaacauacgagagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuuuaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagagacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6004 - RNA, 9879 nt, Artificial Sequence
  derived and/or modified CDS sequence (wt) from DENV-1__GU131729__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggaugucuucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugggcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucaugguuaguccacaaacaaugguuuuuagaccuaccacugccuuggaccucgggagcuucaacaucacaagagacuuggaacagacaagaucugcuggugacauuuaagacagcucaugcaaagaagcaggaaguagucgugcuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuuaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagccuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugauacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggacccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuaugucagugccauagcucaagccaaagcaucacaagaagggccccuaccagagauugaagacgagguguucaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacauacaggaaaagagauaguugaccuaaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcagaaaaaccuuugauacagaguaccaaaaaacaaaaaacaacgacugggacuacgucgucacaacagacaucuccgaaaugggagcaaauuuccgagccgccagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggacccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguagaaccagagguagccaaccuagauaucauuggccagaggauagagaacauaaaacaugaacauaagucaacauggcauuaugaugaggacaauccauauaaaacaugggccuaucauggaucauaugagggcaagccaucaggaucagccucauccaugggcaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaacuuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcagcaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauuggaucccaaccagccguaccaccuggucgauccaugcccaucaccaauggaugacgacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6005 - RNA, 9879 nt, Artificial Sequence
  derived and/or modified CDS sequence (wt) from DENV-1__GU131730__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcuauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucgggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaguacaaauacucguggaaaagcuggggaaaagcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaggaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacccuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagccguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaacaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccaggggguauaucucaacccgagugggcaugggugaggcagcugcgaucuucaugacagccacuccuccaggaucaguggaggccuuuccccagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccccaauaaggaaggugaccaguacaucuacaugggacagccuuuaaacaacgaugaagaucaugcccccuggacagaagcaaaaaugcuccuugauaauauaaacacaccagaaggaauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuucuaucaggaagggggcuagggaaaacauccaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaaccauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccuccugaugcggacuacaugggcccugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacgacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6006 - RNA, 9879 nt, Artificial Sequence
  derived and/or modified CDS sequence (wt) from DENV-1__GU131731__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggaucauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgcccuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguuuuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacugacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgacuucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucgggaaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguagaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggacccacaauaaggaaggugaucaguacaucuccaugggacagccuuuaaacaccgccgaagaucacgcucccuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuagacaaccuggucauguugcacaacuccgaacaaggaggaagagccuauagacaugcaauggaagaauugccagacaccauagaaacgcugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacaggcaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagacuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggccaugaggacccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaauaugacaucuagaauguugcuaaaucgauucacaauggcucacaggaaaccaacauaugaaagagacguggaccuaggcgcuggaacuagacauguggcuguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaauucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuggccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6007 - RNA, 9879 nt, Artificial Sequence
  derived and/or modified CDS sequence (wt) from DENV-1__GU131733__SS-prME
ucugugaccauguuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugacuugugugaggguaccacaguuguuguggaugaacauuguggaaaucgaggaccaucucuuaggaccacaacagucacaggaaagauaauucaugaaugguguugcagaucuugcacguuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagcugaccuaucauuagagaaagcggcugaggucuccugggaagaagaagcagaacacucuggugccucacacaauauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuacagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccagagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuaugucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaacauagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucuaugaagagauucaagaacgagagugaucccgaaggggcacucugguga

SEQ ID NO: 6008 - RNA, 9879 nt, Artificial Sequence
  derived and/or modified CDS sequence (wt) from DENV-1__GU131734__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacagacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaaugacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacugggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacagacucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucugucggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacuguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggcuacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcaucaugauuuuaaaauuauugauugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauccaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggcgaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggguggaaccuaguaaaacugcacuccgggaaagacguauucuuuauaccacccgagaaaugugacacccuuuugugugauauuggugaguccucuccaaacccaacuauagaggaaggaagaacgcuacgcguccuuaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcagcagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 6009 - RNA, 9879 nt, Artificial Sequence
  derived and/or modified CDS sequence (wt) from DENV-1__GU131738__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccguugcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaggggaucauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaaaaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagacugauaacagcuaauccuauagucacugacaaagaaaaaccagucaacauugaggcagaaccgcccuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaauuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguuuuccuccuucucauaauggggcaauugacauggaaugaccugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauucuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaucugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugggagaucauggaacucaggauaugaguggaucacugacuucccagguaaaacaguuugguuugguccaaccaucaaaucaggaaaugacauugccaacugcuuaagaaagaaugggaaacggguaauucaauugagcaggaaaaccuuugauacagaguaccaaaaaacaaaaaauaacgauugggacuaugucggcacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuagacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuucuuaauggugcugcuuauuccagagccagacaggcaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagacuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuagugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcuguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugggcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggaaaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuagguaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaccuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6010 - RNA, 9879 nt, Artificial Sequence
  derived and/or modified CDS sequence (wt) from DENV-1__JF937604__SS-prME
ucugugaccaugcuccuuaugcugaugccuacagccuuggcguuccauuugacuacacgagggggagagccgcacaugauagucaguaagcaggaaagaggaaagucacucuuguuuaagaccucagcaggugucaacaugugcacccuuauagcgauggauuugggagaguugugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguagagacuugggcccugagacacccaggauucacggugauagcccuuuuucuagcacaugccauaggaacauccaucacccagaaagggaucauuuucauuuuguuaaugcugguaacaccauccauggccaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuuuggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacacugcaugggacuuugguucuauaggaggaguguucacgucuguuggaaaauuaguacaccagacuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauucuuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucucacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucauaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacccuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuacagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauucuggaacacaggagaagaagugcaggugauugcuguugaaccagggaaaaaccccaaaaauguacaaacagcaccgggcaccuuuaagaccccugaaggugaaguuggagccauugcccuagacuucaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagcuauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugacacagaguaccaaaaaacaaaaaacaacgacugggacuacgucgucacaacagacaucuccgaaaugggagcaaauuuccgagccgacagggugauagacccaagacggugucugaaaccggugauacuaaaagaugguccagagcgugucauuuuggcaggaccaaugccagugacuguggccagugccgcucagagaagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacgcagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcauaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuuccuugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagacuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaauaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaagagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguguucuuuauaccaccugagaaaugugacacccuuuugugugauaucggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacaccacacccuuuggacaacagaggguguuuaaagagaaaguugacacacgcacaccaaaagcaaaacagggcacagcacaaaucauggaggugacagccaagugguugugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucacagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccaacugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccuaagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6011 - RNA, 9879 nt, Artificial Sequence
  derived and/or modified CDS sequence (wt) from DENV-1__JF937605__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacauuacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagagccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugagcauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaauuuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcuaaggucuccugggaagaagaagcagaacacucuggugccucacacaacauauuaguggaaguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccaaugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccugcuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuucacaggagagaccugagacuagccgcuaaugcuaucuguucggccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6012 - RNA, 9879 nt, Artificial Sequence
  derived and/or modified CDS sequence (wt) from DENV-1__JF937608__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaaaaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacuccugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucucauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccucaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacaacgccgggcacuuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguuuuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuggggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagcggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6013 - RNA, 9879 nt, Artificial Sequence
  derived and/or modified CDS sequence (wt) from DENV-1__GU131739__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucucuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagagguuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguaguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacgguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauucccuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgccaaccauucuccuuaaagcaacucuguuagcaguuucagggguguacccauuaucaauaccagcgacccuuuucgugugguacuuuuggcaaaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauaggucuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauacacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaaccuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6014 - RNA, 9879 nt, Artificial Sequence
  derived and/or modified CDS sequence (wt) from DENV-1__GU131740__SS-prME
ucugugaccaugcuccuuauguugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaagggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagauguaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaacuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacauuauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacguuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagggaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuuuacauuuaucaaaacaacguuuuccuugcacuaugcguggaagacaauggccaugguacugucaauuguaucucucuuccccuuaugccuguccacgaccucccaaaaaacaacauggcuuccggugcuauugggaucucuuggaugcaaaccauuaaccauguuucuuauagcagaaaacaaagucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaagucggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaagacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccucuugucucccgugagaguucccaauuacaacaugauuaucauggaugaagcgcauuucaccgauccauccagcauagcggccagaggguacaucucaacccgagugggcaugggugaagcagcugcgaucuucaugacagcuacucccccaggaucaauggaggccuuuccacagagcaacgcaguuauccaagaugaggaaagagacauuccugagagaucauggaacucaggcuaugaguggaucacugacuucccgggcaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaccaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccaugcggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuagggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaacuuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagagaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6015 - RNA, 9879 nt, Artificial Sequence
  derived and/or modified CDS sequence (wt) from DENV-1__GU131741__SS-prME
ucugugaccaugcuccuuaugcuaaugccuacagccuuggcguuccauuugacuacacgagggggagagccgcacaugauagucagcaagcaggaaagaggaaagucacuuuuguuuaagaccucagcaggugucaacaugugcacccucauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgccuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaagcugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggaguuucaacaucacaagagaccuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauacguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcugggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucauacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuagcuguguucuuccuucucauaaugggacaauugacauggaaugaucugaucagauuaugcaucaugguuggagccaacgcuuccgauaggauggggaugggaacgacguaccuagcucugauggccacuuuuaaaaugagaccaauguuugcuguaggacuauuauuccgcagacuaacauccagagaaguacuucuucuaacaauuggauugagucuaguggcaucuguggaguuaccaaauuccuuggaggaguuaggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucucaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggcuauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccaguauagcggccagaggguacaucucaacccgaguggguaugggugaagcagcugcgaucuucaugacagcuacucccccaggaucaguggaggccuucccacagagcaacgcaguuauccaagaugaggaaagagacauuccugagagaucauggaacucaggcuaugaguggaucacugacuucccggguaaaacaguuugguuuguuccaagcaucaaaucaggaaacgacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccuuuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcauacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacgcaaauagccaugacugacacuacaccuuuuggacaacagaggguguucaaagagaaaguugauacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaauaugauggggaagagagagaaaaaacuaggagaguucggaaaggcuaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauuuaagaacgagagugauccugaaggggcacucugguga

SEQ ID NO: 6016 - RNA, 9879 nt, Artificial Sequence
  derived and/or modified CDS sequence (wt) from DENV-1__GU131743__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggugucuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaauauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcggaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagaugucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacggccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggauguuauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcugggaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuucaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6017 - RNA, 9879 nt, Artificial Sequence
  derived and/or modified CDS sequence (wt) from DENV-1__JN093516__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaaaaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaauugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguccaacaugaaaacuugaaauauucaguaauagucaccguccacacuggagaccagcaccaggugggaaaugaaagcacagagcaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccauugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacuaccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguccugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacugguacacuggccguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaacuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaauauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugaucgcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaggacaaccagcuggcauauguagugauagguuuguuauucaugauacugacaguagcagccaaugagaugggacugcuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugugaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggggaaacaaccaaacacgcagugucgagaggaacagcuaaacugaggugguuuguggagaggaaucuugugaaaccagaagggaaagucauagaccuugguuguggaagagguggcuggucauacuauugcgcugggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaucuaggcgccggaacaagacauguggcaguggaaccugagguagccaaccuagauaucauuggccagaggauagagaacauaaaacaugaacauaagucaacauggcauuaugaugaggacaacccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugagugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6018 - RNA, 9879 nt, Artificial Sequence
  derived and/or modified CDS sequence (wt) from DENV-1__GU131746__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggaugucuucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucaugguuaguccacaaacaaugguuuuuagaccuaccacugccuuggaccucgggagcuucaacaucacaagagacuuggaacagacaagaucugcuggugacauuuaagacagcucaugcaaagaagcaggaaguagucgugcuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcgacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuuaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagccuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcauuacgcauggaagacaauggcuaugauacugucaauuguaucucucuucccuuuaugccuguccacgaccucccaaaaaacaacauggcuuccgguguuauugggaucccuuggaugcaaaccacuaaccauguuucuuauagcagaaaauaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuaugucagugccauagcucaagccaaagcaucacaagaagggccccuaccagagauugaagacgagguguucaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacauacaggaaaagagauaguugaccuaaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaaaggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccagcguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguagaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaacuuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauuggaucccaaccagccguaccaccuggucgauccaugcccaucaccaauggaugacgacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6019 - RNA, 9879 nt, Artificial Sequence
  derived and/or modified CDS sequence (wt) from DENV-1__JF937609__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagagaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucucauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacaacgccgggcacuuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcagaaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacgaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguuuuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuggggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucaaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugguauuauggaaguggacagauccgaagccaaagagggauugaaaagaggagaaacaaccaaacaugcagugucgagaggaaccgcuaaacugagaugguuuguggagcggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguuuuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaggucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6020 - RNA, 9879 nt, Artificial Sequence
  derived and/or modified CDS sequence (wt) from DENV-1__KF921949__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccguggcacuggccccacaugugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacauuguaauaggagcaggugaaaaagcuuugaaacuaagcugguucaggaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucuugagaacaucauguggaagcaaauaucaaaugaacugaaucacaucuuacuugaaaaugauaugaaauucacaguggucguaggagauguuacugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaauuggauuuugauuugugugaggguaccacaguuguuguggaugaacauuguggaaaccgaggaccaucucuuaggaccacaacagucacagggaagauaauucaugaauggugcugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguuccuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauuaggaucccuuggaugcaaaccacuaaccauguuucuuauagcagaaaacaaaaucuggggaaggagaaguuggccccucaaugaaggaaucauggcuguuggaauagucagcauccuacuaaguucacuccuuaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugccguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagcaaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucaugccacuuucaccaugcgccuccugucucccguaaggguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccauuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggguugaaaagaggagaaacaaccaaacaugcagugucgagaggaaccgcuaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuuguauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaaaaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcgauaugguacaugugguugggagcacgcuuucuugaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuugcucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6021 - RNA, 9879 nt, Artificial Sequence
  derived and/or modified CDS sequence (wt) from DENV-1__GU131747__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaaguuacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucugcuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauauaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcagggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuuuugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccguucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucacuaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcagaaaaaccuuugauacagaguaccaaaaaacaaaaaacaacgacugggacuacgucgucacaacagacaucuccgaaaugggagcgaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagugucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacguacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacaccacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaacauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6022 - RNA, 9879 nt, Artificial Sequence
  derived and/or modified CDS sequence (wt) from DENV-1__GU131748__SS-prME
ucugugaccaugcucuuuaugcuggugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuggaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauuuacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaauuacagaccaggauauuuuacacaaacagcagggccguggcaccuaggcaaguuggaacuggauuuugauuugugugaggguaccacaguuguuguagaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucguguggcacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucacuaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuucgauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggaguaacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagauagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggccuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucaaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6023 - RNA, 9879 nt, Artificial Sequence
  derived and/or modified CDS sequence (wt) from DENV-1__GQ868615__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacgcuccgucgcacuggccccacaugugggacuugguuuggaaacaagaaccgaaacguggaugucuucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucaugguuaguccacaaacaaugguuuuuagaccuaccacugccuuggaccucgggagcuucaacaucacaagagacuuggaacagacaagaucugcuggugacauuuaagacagcucaugcaaagaagcaggaaguagucgugcuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguuuagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuuaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggacuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauaaugggacaauugacauggaacgaucugaucagauuaugcaucaugguuggagccaacgcuucugacaggauggggaugggaacgacguaccuagcccugauggccacuuuuaaaaugagaccgauguuugcuguagggcuauuauuucgcagacuaacauccagagaaguucuucuucuaacaauuggauugagccuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugauacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuaugucagugccauagcucaagccaaagcaucacaagaagggccccuaccagagauugaagacgagguguucaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacauacaggaaaagagauaguugaccuaaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguagaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaacuuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauuggaucccaaccagccguaccaccuggucgauccaugcccaucaccaauggaugacgacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6024 - RNA, 9879 nt, Artificial Sequence
  derived and/or modified CDS sequence (wt) from DENV-1__GU131749__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguggagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccaacaucaggugggaaaugaaagcacagaacaugggacaacugcaacuauaacaccucaagcucccacgacggaaauacagcugaccgacuacggagcucuuacauuggauuguucaccuagaacgggacuagacuuuaaugaaaugguguuguugacaaugaaagaaaaaucauggcuaguccacaaacaaugguuucuagacuuaccacugccuuggacuucgggagcuucgacaucacaagagacuuggaauagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaauauugaggcagaaccgccuuuuggugagaguuacaucgugauaggagcaggugaaaaagcuuugaaacuaagcugguucaagaaaggaaguagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauagaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguaucuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauccauggaggaccaauaucucagcacaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugauagaagaggugaugagauccagauggaguagaaaaaugcugaugacuggaacacuggcuguguucuuccuucucauaaugggacaguugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacacuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcaaagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgagauggcagaagcgcucaagggaaugccaauaagguaccaaacaacagcagugaagagugaacacacaggaaaagagauaguugaccucaugugucacgcuacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagaguaacgcaguuauccaagaugaggaaagagacauuccugagagaucauggaacucaggcuaugaguggaucacugacuuuccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacagacaucuccgaaaugggagcaaauuuccgggccgacagggugauagacccaagacggugucugaaaccgguaauauuaaaagaugguccagagcgugucauuuuggcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccggagagagaaaagagugcagcaauagacggggaauauagacugcggggugaagcaaggaaaacguuuguggagcucaugagaagaggagaccuaccugucuggcuguccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggauggccaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaauauuucccugacagccauugcaaaccaggcagccauauugaugggacuugacaaaggauggccaauaucgaagauggacauaggaguuccacuucucgccuuggggugcuauucccaggugaauccacugacacugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugugaauccaucacacuggccacuggaccucugaccacgcuuugggagggaucuccaggaaaauuuuggaacaccacgauagcgguuuccauggcaaacauuuuuagaggaaguuaucuagcaggagcagguuuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguucguggagaggaaccuugugaaaccagaagggaaagucauagaccuugguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuucauaccaccugagaaaugugauacccuuuugugugauauuggugaguccucuccaaacccaacuauagaggaaggaagaacgcuacgcguucuaaagaugguggaaccauggcucagaggaaaccaauuuugcauaaagauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaauaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggggaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaaucuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuauuuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccgcauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 6025 - RNA, 9879 nt, Artificial Sequence
  derived and/or modified CDS sequence (wt) from DENV-1__GU131750__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauagguagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagauuuuaaugaaaugguguuguugacaaugaaagaaaaaucauggcuaguccacaaacaaugguuuuuagaccuaccacugccuuggaccucgggagcuucaacgucacaagagacuuggaacagacaagauuuguuggugacauuuaagacagcucaugcaaagaagcaggaaguagucguacugggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauuacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagaacaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucaauagagaaagcggcugaggucuccugggaagaagaagcagaacauucuggugccucacacaacauauuaguggaaguccaagacgauggaaccaugaagauaaaggaugaagagagagaugacacgcuaaccauucuccuuaaagcaacucuguuagcaguuucagggguguacccauuaucaauaccagcgacccucuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccauacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcucuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccugagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugaugcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaauugaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggagugggauuauggaaguggacagauccgaagccaaagagggauuaaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaaugcugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggcugggauacaaggauaacagaggaugaccuucagaaugaggccagaauuacugacaccauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucaccuagcgaauuagagaccccaaauuuagccgagagaguucucgacuggcuggaaaaguauggcgucgaaaggcugaaaagaauggcaaucagcggagaugacugcguagugaaaccaauugaugauagguuugcaacagccuugacagcucuaaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6026 - RNA, 9879 nt, Artificial Sequence
  derived and/or modified CDS sequence (wt) from DENV-1__GU131751__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauucuguuaaugcugguaacaccauccauggcaaugcgaugugugggaauagguagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaauugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggauaagcugacucuaaaggggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaagugauuaggccacaacccauggaacacaaauacucguggaaaaguuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucagggacagcaaggcaguucacgcugacaugggguacuggauagaaagugaaaagaacgagaccuggaagcuggcaagagccucuuucauagaaguuaaaacauguaucuggccaaagucccacacucuauggagcaaugguguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacgguucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccaaauggaguagaaaaaugcugaugacuggaacacuggcuguguucuuccuucucauaaugggacaacugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcugucuuugacauuuaucaaaacaacguuuuccuugcacuaugcauggaagacaauggccaugguacugucaauuguaucucucuuccccuuaugccuguccacaaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucccauaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacauaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaggaccugaucucauauggaggagguuggagacuucaaggauccuggaacacgggagaagaagugcaggugauugcuguugaaccaggaaaaaaccccaaaaauguacaaacagcgccgggcacuuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaagaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagaguaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguuacacaacuccgaacaaggaggaagagccuauagacaugcaauggaggaauugccagacaccauagaaacguugaugcuccuagcuuugauagcuguguuaacugguggagugacgcuguucuuccuaucaggaagaggccuagggaaaacaucuaucggccuacucugcgugauggcuucaagcguacugcuauggauggccaguguggagccccauuggauagcggccuccaucauauuggaguucuuccugauggugcugcuuauuccagagccagacagacaacgcacuccgcaggacaaccagcuggcauacguggugauagguuuguuauucaugauacugacaguagcagccaaugagaugggacugcuagaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcgacgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccuuuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucacuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaaguaaagggauauacgaaaggaggacccggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcugaaucgauucacaauggcucacaggaaaccaacguaugaaagagacguggaccuaggcgccggaacaagacauguggcaguggaaccugagguagcuaaccuagauaucauuggccagaggauagagaacauaaaacaugaacauaagucaacauggcauuaugaugaggacaauccauacaaaacaugggccuaccauggaucauaugaggucaagccaucaggaucagccucauccaugguuaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcgguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauacauacucagagacauaucaaagauuccagggggaaacauguaugcagaugacacagccggaugggauacaaggauaacagaggaugaccuucagaacgaggcaaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaauauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6027 - RNA, 9879 nt, Artificial Sequence
  derived and/or modified CDS sequence (wt) from DENV-1__GU131753__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcaauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugacagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugacugacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggccgagacccagcauggaaccguuuuagugcagauuaaauacgaaggaacagaugcaccaugcaagaucccuuuuucgacccaagaugaaaaaggaguaacccagaaugggagacugauaacagcuaauccuauaaucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuauuggaaaacuaguacaccagauuuuuggaacugcauauggaguuuuguucagcgguguuuccuggaccaugaaaauaggaauagggguucugcugacauggcuaggauugaacucaaggagcacgucccuuucaaugacgugcauugcaguuggccuaguaacacuauaccuaggagucaugguucaggcggauucaggauguguaauuaauuggaaagguagggagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcccaaggaaaaaaaaugauuaggccacaaccuauggaacacaaauacucguggaaaagcuggggaaaagcuaaaaucauaggggcagaugugcagaacaccaccuucaucaucgacggcccaaacaccccagaaugcccugaugaucaaagagcauggaacauuugggaaguugaggacuauggauuuggaauuuucacgacaaauauaugguugaaaaugcgugacuccuacacccaagugugugaccaccggcuaaugucagcugccaucaaggacagcaaggcaguucaugcugacaugggguauuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguaggaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaagagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucauccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaauuauggcuguuggaguagucagcauccuacuaaguucacuucuaaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaagaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucuugaugaugguaucuauagaauaaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagcgccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccaugaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccucucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagaggucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugacacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaauacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagagggagaaagaaagaaacuacgaccccgcuggcuggaugccagaacauacucagacccacuggcccugcgcgaguuuaaagaguuugcagcaggaagaagaagcgucucaggugaucuaauauuagagauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagccguguugacugguggagugacgcuguucuuccuaucaggaaggggccuagggaaaacaucuaucggcuuacucugcgugacggcuucaagcguacugcuauggauggccaguguggaaccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuagaaaccacaaagaaagaccuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucucgccuugggaugcuauucacaggugaauccacugacgcugacagcggcgguauugaugcuaguggcucacuacgccauaaucggaccuggauugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccauuacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccaaacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugacauuggugaguccucuccaaacccaaccauagaagaaggaagaacguuacgcguccuaaaaaugguggaaccauggcuuagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaaaagacguggaccuaggcgcuggaacuagacauguggcaguggaaccagaaguagccaaccuggauaucauuggccagaggauagagaacauaaaacaugagcacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuucggacaacagaggguguucaaagagaaaguugacacgcgcacaccaaaagcaaaacgaggcacagugcaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugaaaaaagagagggagcuucacaaacagggaaaaugugccacguguguuuacaacaugauggggaagcgagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaacauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaacugugauggaugucauauccagacgugaccaaagaggaaguggccaggucggaacuuauggcuugaacacuuucaccaacauggaagcccagcuaauaagacaaauggagucugagggaaucuuuuuacccagcgaauuggagaccccaaauuuagccgagaggguuuucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccagucgauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6028 - RNA, 9879 nt, Artificial Sequence
  derived and/or modified CDS sequence (wt) from DENV-1__GU131754__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuagaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagaugcccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuccuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggauaagcugacucuaaaggggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagacaaaccagucaacauugaggcagaaccgccuuuuggugagagcuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguuuacgucuguuggaaaauuaguacaccagauuuuuggaacugcauauggaguuuuguucagcgguguuucuuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaguuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgccgacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaacugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaagugcuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugcauguccacaaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccguuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagacgacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguaggcguaggaguuuuccaagaaaacguguuccacacaauguggcaugucaccaggggagcuguacucauguaucaagggaagagacuggaaccgagcugggccagugucaaaaaggaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacacccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagaguaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacgucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaagucgccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaauuugguuauguugcacaacuccgaacaaggaggaagagccuauagacacgcaauggaggaauugccagacaccauagaaacguugaugcuccuagcuuugauagcuguguuaacugguggagugacgcuguucuuccuaucaggaagaggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaggacaaccagcuggcauacguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaauauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuaguacgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagcuaaccuagauaucauuggccagaggauagagaacauaaaacaugaacauaagucaacauggcauuaugaugaggacaauccauacaaaacaugggccuaccauggaucauaugaggucaagccaucaggaucagccucauccaugguuaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuucuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6029 - RNA, 9879 nt, Artificial Sequence
  derived and/or modified CDS sequence (wt) from DENV-1__GU131755__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauugcugguguaaugccacagacacaugggugaccuauggaacauguucccaaacuggugagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaagggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcugggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaccugaucagauuaugcaucaugguuggagccaacgcuuccgacaggauggggaugggaacgacguaccuagcccugauggccacuuuuaaaauuagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacugcgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuucccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacuguuuaagaaagaacgggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaauauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacacuauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacaaacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccuuuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucauugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguuaggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugauacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaucaagugagaagacuaauagggaaugagaauuaucuagauuacaugacaucaaugaagagauucaagaacgagagugaucccgaaggggcacucugguga

SEQ ID NO: 6030 - RNA, 9879 nt, Artificial Sequence
  derived and/or modified CDS sequence (wt) from DENV-1__GU131756__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggaucugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacaacugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaaaaaaaugauuaggccacaacccauggaguacaaauacucguggaaaagcuggggaaaagcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcugcguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuguugacugauuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaauggaaaacgggugauucaguugagcaggaaaacuuuugauacagaguaccaaaaaacaaaaaauaacgacugggacuacgucgucacaacagacaucucugaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcccacuggacagaagcaaaaaugcuccuugauaauauaaacacaccagaagggauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggaccacaugggccuugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacacaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaaucuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6031 - RNA, 9879 nt, Artificial Sequence
  derived and/or modified CDS sequence (wt) from DENV-1__GU131758__SS-prME
ucugugaccaugcuccuuauguugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaagggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagauguaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaacuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacauuauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacguuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuuuacauuuaucaaaacaacguuuuccuugcacuaugcguggaagacaauggccaugguacugucaauuguaucucucuuccccuuaugccuguccacgaccucccaaaaaacaacauggcuuccggugcuauugggaucucuuggaugcaaaccauuaaccauguuucuuauagcagaaaacaaagucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaagucggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaagacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccucuugucucccgugagaguucccaauuacaacaugauuaucauggaugaagcgcauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccgggcaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaccaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaggacuuagggauuggccaugcggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuagggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaacuuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagagaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6032 - RNA, 9879 nt, Artificial Sequence
  derived and/or modified CDS sequence (wt) from DENV-1__GU131759__SS-prME
ucugugaccaugcuccuuauguugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaaaacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaagggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaacuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacauuauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacguuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuuuacauuuaucaaaacaacguuuuccuugcacuaugcguggaagacaauggccaugguacugucaauuguaucucucuuccccuuaugccuguccacgaccucccaaaaaacaacauggcuuccggugcuauugggaucucuuggaugcaaaccauuaaccauguuucuuauagcagaaaacaaagucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaagucggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaagacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccucuugucucccgugagaguucccaauuacaacaugauuaucauggaugaagcgcauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccgggcaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaccaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuaucccacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccaugcggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuagggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaacuuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagagaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6033 - RNA, 9879 nt, Artificial Sequence
  derived and/or modified CDS sequence (wt) from DENV-1__GU131761__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggaugucuucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucaugguuaguccacaaacaaugguuuuuagaccuaccacucccuuggaccucgggagcuucaacaucacaagagacuuggaacagacaagaucugcuggugacauuuaagacagcucaugcaaagaagcaggaaguagucgugcuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuuaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagccuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugauacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauacaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuaugucagugccauagcucaagccaaagcaucacaagaagggccccuaccagagauugaagacgagguguucaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacauacaggaaaagagauaguugaccuaaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagcccuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagauuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaacuuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauuggaucccaaccagccguaccaccuggucgauccaugcccaucaccaauggaugacgacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6034 - RNA, 9879 nt, Artificial Sequence
  derived and/or modified CDS sequence (wt) from DENV-1__GU131762__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcagguguuaacaugugcacccuuauagcgauggauuugggagaguuuugugaggauacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcguuaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggauaagcugacucuaaaggggaugucauauguaaugugcacaggcucauucaagcuagagaaagaaguggccgagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacggaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcaugucccuuucgaugacgugcauugcaguuggccuaguaacauuauaccuaggagucaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaacugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacaaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuuuugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaggaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuauaacaugauuaucauggaugaagcacauuucacugauccauccagcauagcggccagaggguacaucucaacccgagugggcaugggugaagcagcugcgaucuucaugacagcuacucccccaggaucaguggaggccuuuccacagaguaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcccacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaguauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucuggucauguugcacaacuccgaacaaggaggaagagccuauagacaugcaauggaggaauugccagacaccauagaaacguugaugcuccuagcuuugauagcuguguuaacugguggagugacgcuguucuuccuaucaggaagaggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggcuggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacacuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauacacgaaaggaggaccuggacaugaggagccaauuccaauggcgaccuauggauggaaccuaguaaaacugcacuccgggaaagauguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaauccuuacaugccaagcgugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagcuaaccuagauaucauuggccagaggauagagaacauaaaacaugaacauaagucaacauggcauuaugaugaggacaauccauacaaaacaugggccuaccauggaucauaugaggucaagccaucaggaucagccucauccaugguuaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggggcaguguucguugaugaaaaucaauggaacucagcaaaagaagcaguggaagaugagcgguucugggaccuugugcacagagagagggagcuucacaaacagggaaaaugugccacguguguuuacaacaugaugggaaagagagagaaaaaacuaggagaguucggaaaggcaaaaggaagccgugcaauaugguacauguggcugggagcacgcuuucuagaguucgaagcccuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccaacugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuucuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugccaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuaauugggaaugagaauuaucuagauuauaugacaucaaugaagagauucaagaacgagagugauccugaaggggcacucugguga

SEQ ID NO: 6035 - RNA, 9879 nt, Artificial Sequence
  derived and/or modified CDS sequence (wt) from DENV-1__GU131763__SS-prME
ucugugaccaugcuacuuaugcugaugcccacagccuuggcguuccaucugacuacacgagggggagagccacauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggcuaugcgaugcgugggaauaggcaguagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacauuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucaccuagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcaaauccuauagucacugacaaagaaaaaccagucaacauugaggcagaaccgcccuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccucguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagggcauggaacauuugggaaguugaggacuauggauuuggaauuuucacgacaaauauaugguugaaauugcgugacuccuacacucaagugugugaccaccggcuaaugucagcugccaucaaggacagcaaggcaguccaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuucaaaggagaagauggguguugguacgguauggaaaucagaccaguuaaggaaaaggaagagaaucuagucaaaucaauggucucugcaggguuaggggaaguggacagcuuuucacuaggacugcuaugcauaucaauaaugaucgaagaggugaugagauccagauggaguagaaaaauguugauggcuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuaucaaaacaacgcuuuccuuacacuaugcauggaagacaauggcuauggugcugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcucgcugggccacuaauagcuggaggcaugcuaauagcauguuaugucauaucuggaagcucagccgacuuaucauuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaauuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaaggaaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaagacaagaagauaucucccagccauaguccgugaggccauaaaaagaaagcugcgcacacuaauuuuggcucccacaagaguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagauugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccauuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaacugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaggacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugaguaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacucugggaaagacguauucuuuacaccaccugagagaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacggccggaugggauacaaggauaacggaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuaccuagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaagguuuggauagaggaaaacccauggauggaggacaaaacccauguauccaguuggggagauguuccauaucuagggaaaagggaagaucagugguguggaucccugauaggcuuaacagcaagggccaccugggcauccaacauacaaguggccauaaaccaagugagaagacuaauugggaaugagaauuaucuagauuacaugacaucaaugaagagauucaagaacgagggugaucccgaaggggcacucugguga

SEQ ID NO: 6036 - RNA, 9879 nt, Artificial Sequence
  derived and/or modified CDS sequence (wt) from DENV-1__GU131766__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcaauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcauagaacaugggacaacugcaacuauaacaccucaagcucccacgucagaaauacagcugaccgacuacggagcucuuacauuggauugcucacccagaacaggauuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggccgagacccagcauggaaccguuuuagugcagauuaaauacgaaggaacagaugcaccaugcaagaucccuuuuucgacccaagaugaaaaaggaguaacccagaaugggagacugauaacagcuaauccuauagucauugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuauuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagggagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagaugugcagaacaccaccuucaucaucgacggcccaaacaccccagaaugcccugaugaucaaagagcauggaacauuugggaaguugaggacuauggauuuggaauuuucacgacaaauauaugguugaaaaugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguaggaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaagagcugggagauggacuugcaaugggcauuaugauuuuaaaauuauugacugacuuucagucacaucagcugugugcuacauugcuguccuugacauuuauuaaaacaacgcuuuccuuacacuaugcauggaagacaauggcuaugguacugucaauuguaucucucauccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaauuauggcuguuggaguagucagcauccuacuaaguucacuucuaaaaaaugaugugccgcuagcugggccacuaauagcuggaggcaugcuaauagcauguuaugucauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucucgaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuucugaaauggcagaggcgcucaagggaaugccaauaagguaccaaacaacagcagugaagagugaacacacaggaaaagagauaguugaccucaugugccacgccacuuucaccaugcgucuccugucccccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugauauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggaucaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgauggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagccguguugacugguggagugacgcuguucuuccuaucaggaaggggccuagggaaaacaucuauuggcuuacucugcgugauggcuucaagcguacugcuauggauggccaguguggaaccccauuggauagcggccuccaucauacuggaguucuuccuaauggugcugcuuauuccagagccagacagacaacgcacuccgcaggacaaucagcuagcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucucugacagcuauugcaaaccaggcagccauauugaugggacuugacaaaggauggccaauaucgaagauggacauaggaguuccacuucucgccuugggaugcuauucacaggugaauccacugacgcugacagcggcgguauugaugcuaguggcucacuacgccauaauuggaccuggauugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccauuacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugacauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaaaagacguggaccuaggcgcuggaacuagacauguggcaguggaaccagaaguagccaaccuggauaucauuggccagaggauagagaacauaaaacaugagcacaagucaacauggcauuaugaugaggacaauccauacaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagugcaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugaaaaaagagagggagcuucacaaacagggaaaaugugccacguguguuuacaacaugauggggaagcgagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaacauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaacugugauggaugucauauccagacgugaccaaagaggaaguggccaggucggaacuuauggcuugaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaaggaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguuaucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6037 - RNA, 9879 nt, Artificial Sequence
  derived and/or modified CDS sequence (wt) from DENV-1__GU131767__SS-prME
ucugugaccaugcuccuuaugcugaugccuacagccuuggcguuccauuugacuacacgagggggagagccgcacaugauagucagcaagcaggaaagaggaaagucacuuuuguuuaagaccucaguaggugucaacaugugcacccuuauagcuauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucgggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaacgaacugaaccacaucuuacuugaaaaugacaugaaacucacagugguuguaggagauguugcuggaaucuuggcucaagggaaaaaaaugauuaggccacaacccauggaguacaaauacucguggaaaagcuggggaaaagcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaggaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagccguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccaggggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcccacuggacagaagcaaaaaugcuccuugauaauauaaacacaccagaaggaauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuucuaucaggaagggggcuagggaaaacauccaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaaccauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccuccugaugcggacuacaugggcccugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccagggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacgacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6038 - RNA, 9879 nt, Artificial Sequence
  derived and/or modified CDS sequence (wt) from DENV-1__HM181967__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugagcauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaauuuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauauggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacaccacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuucacaggagagaccugagacuagccgcuaaugcuaucuguucggccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6039 - RNA, 9879 nt, Artificial Sequence
  derived and/or modified CDS sequence (wt) from DENV-1__GU131768__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagagcuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggaucauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugccaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauaugaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaauuauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcaauuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguuuuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggcuagugucaaaaaagaccugaucucauauggaggagguuggaggcuucaaggauccuggaacacgggagaagaagugcaggugauugcuguugaaccaggaaaaaaccccaaaaauguacaaacagcgccggggaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuucccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaacaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuagacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacaggcaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccacgccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgcccugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagacuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcuguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugaaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagcggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6040 - RNA, 9879 nt, Artificial Sequence
  derived and/or modified CDS sequence (wt) from DENV-1__GU131770__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauugcugguguaaugccacagacacaugggugaccuauggaacauguucccaaacuggugagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaagggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcugggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaccugaucagauuaugcaucaugguuggagccaacgcuuccgacaggauggggaugggaacgacguaccuagcccugauggccacuuuuaaaauuagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacugcgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuucccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacuguuuaagaaagaacgggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaauauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacacuauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacaaacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccuuuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguuaggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugauacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6041 - RNA, 9879 nt, Artificial Sequence
  derived and/or modified CDS sequence (wt) from DENV-1__GU131773__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguagagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugucgacgaacguuuguggacagaggcuggggcaauggcugugggcucuucggaaaaggaagccuacuaacgugugcuaaguucaaguguaugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucgacaucacaagagacuuggaauagacaagauuugcuggugacauuuaagacagcucaugcaaagaagcaggaaguagucguauuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauccauggaggaccaauaucucagcacaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuuuacuaggacugcuaugcauaucaauaaugaucgaagagguaaugagauccagauggaguaggaaaaugcugaugacuggaacacuggcuguguucuuccuucucauaaugggacaguugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacacuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgagauggcagaagcgcucaagggaaugccaauaagguaccaaacaacagcagugaagagugaacacacaggaaaagagauaguugaccucaugugucacgcuacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagaguaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacagacaucuccgaaaugggagcaaauuuccgggccgacagggugauagacccaagacggugucugaaaccgguaauauuaaaagaugguccagagcgugucauuuuggcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccggagagagaaaagagugcagcaauagacggggaauauagacugcggggugaagcaaggaaaacguuuguggagcucaugagaagaggagaccuaccugucuggcuguccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggauggccaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugugaauccaucacacuggccacuggaccucugaccacgcuuugggagggaucuccaggaaaauuuuggaacaccacgauagcgguuuccauggcaaacauuuuuagaggaaguuaucuagcaggagcagguuuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuucauaccaccugagaaaugugauacccuuuugugugauauuggugaguccucuccaaacccaacuauagaggaaggaagaacgcuacgcguucuaaagaugguggaaccauggcucagaggaaaccaauuuugcauaaagauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggggaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaauuuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 6042 - RNA, 9879 nt, Artificial Sequence
  derived and/or modified CDS sequence (wt) from DENV-1__GU131775__SS-prME
ucugugaccaugcuucucaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggaucauuuucauuuuguuaaugcugguaacaccauccauggccaugcgaugcguaggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaguagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgcccuuuggugagaguuacaucguaauaggagcagguggaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguuuuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacugacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaucugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaagucggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuagacaaccuggucauguugcacaacuccgaacaaggaggaagagccuauagacaugcaauggaagaauugccagacaccauagaaacgcugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacaggcaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguagauggaauuguugcaauagacuuggacccuguggucuaugaugcaaaauuugagaaacaacuaggccaaauaauguuguuaauauuaugcaccucacagauccucuugaugaggaccacaugggccuuaugcgaauccaucacacuggccacuggaccucugaccacgcuuugggagggaucuccagggaaauuuuggaacacuacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcuguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggacgucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6043 - RNA, 9879 nt, Artificial Sequence
  derived and/or modified CDS sequence (wt) from DENV-1__GU131777__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacuccugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucucauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccucaaagcaacucugcuagcaauuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacaacgccgggcacuuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguuuuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuggggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagcggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacgucaaugaagagauucaagaacgagagugaucccgaaggggcacucugguga

SEQ ID NO: 6044 - RNA, 9879 nt, Artificial Sequence
  derived and/or modified CDS sequence (wt) from DENV-1__GU131778__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaagggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggacuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaacuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaggucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacgcuucaaaggagaagauggguguugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggacugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccgcuaaccauguuucucauagcagaaaacaaaaucuggggaaggaaaaguuggccucucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacauaccuagcccuccagaaguggaaagagcaguucuugaugaugguaucuauagaaucaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccucuugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagauauuccugagagaucauggaacucaggcuaugaguggaucacugacuucccgggcaaaacaguuugguuuguuccaaguaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaccaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuacaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucaugugggacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaaagaggcacagcacagaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaggauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaagugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauucaugcccaucaccaauggaugacaacagaagacaugcugucaguguggaauaggguuuggauagaggagaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6045 - RNA, 9879 nt, Artificial Sequence
  derived and/or modified CDS sequence (wt) from DENV-1__GU131779__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacuccugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuagugguaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucucauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccucaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacaacgccgggcacuuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguuuuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuggggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaauugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagcggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6046 - RNA, 9879 nt, Artificial Sequence
  derived and/or modified CDS sequence (wt) from DENV-1__GU131780__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacgggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaagaaguagucguacuaggaucacaagaaggagcaaugcacacugcguugaccggagcaacagaaauccaaacgucuggaacgacaacaauuuuuucaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucauuauugacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuguuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaaguucagccgaccuaucacuagagaaagcagcugaggucuccugggaagaagaagcagaacacucuggugccucacacaacauauuaguagagguccaagaugauggaaccaugaagauaaaggaugaagagagagaugacacgcuaaccauucuccuuaaagcaacucugcuaacagucucagggguguacccauuaucaauaccagcgacccuuuuugugugguacuuuuggcagaaaaagaaacagagaucuggaguguuaugggacacaccuagcccuccaaaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuugacaauaauggaccuacauccaggaucggggaaaacaagaagauaucuuccagccauaguccgugaggccauaaaaaggaagcugcgcacauuaauucuggcuccuacaagaguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguauaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaucagguguuggaggagaacauggacguggagaucuggacaaaagaaggagaaagaaagaaacuaagaccccgcuggcuggaugcuagaacguacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgaugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccuaacagccauugcaaaccaggcggcuauauugaugggacuugacaaaggauggccaauaucgaagauggacauaggaguuccacuucucgccuuagggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauaguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuagguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagcccggagaguucuugacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccaguugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaucaagugagaagacuaauugggaaugagaauuaucuagauuacaugacaucaaugaagagauucaagaacgagagugauccugaaggugcacucugguga

SEQ ID NO: 6047 - RNA, 9879 nt, Artificial Sequence
  derived and/or modified CDS sequence (wt) from DENV-1__GU131781__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuagaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagaugcccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuccuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggauaagcugacucuaaaggggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagacaaaccagucaacauugaggcagaaccgccuuuuggugagagcuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguuuacgucuguuggaaaauuaguacaccagauuuuuggaacugcauauggaguuuuguucagcgguguuucuuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaguuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgccgacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaacugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaagugcuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugcauguccacaaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccguuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagacgacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaggaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacacccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagaguaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacgucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaauuugguuauguugcacaacuccgaacaaggaggaagagccuauagacacgcaauggaggaauugccagacaccauagaaacguugaugcuccuagcuuugauagcuguguuaacugguggagugacgcuguucuuccuaucaggaagaggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauacguggugauagguuuguuauucaugauacugacaguagcagccaaugagaugggacugcuggaaaccacaaagaaagacuuagggauuggucauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaauauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuaguacgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagcuaaccuagauaucauuggccagaggauagagaacauaaaacaugaacauaagucaacauggcauuaugaugaggacaauccauacaaaacaugggccuaccauggaucauaugaggucaagccaucaggaucagccucauccaugguuaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggaacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaggucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuucuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6048 - RNA, 9879 nt, Artificial Sequence
  derived and/or modified CDS sequence (wt) from DENV-1__GU131782__SS-prME
ucugugaccaugcuacuuaugcugaugcccacagccuuggcguuccaucugacuacacgagggggagagccacauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggcuaugcgaugcgugggaauaggcaguagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcaaauccuauagucacugacaaagaaaaaccagucaacauugaggcagaaccgcccuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccucguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagggcauggaacauuugggaaguugaggacuauggauuuggaauuuucacgacaaauauaugguugaaauugcgugacuccuacacucaagugugugaccaccggcuaaugucagcugccaucaaggacagcaaggcaguccaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuucaaaggagaagauggguguugguacgguauggaaaucagaccaguuaaggaaaaggaagagaaucuagucaaaucaauggucucugcaggguuaggggaaguggacagcuuuucacuaggacugcuaugcauaucaauaaugaucgaagaggugaugagauccagauggaguagaaaaauguugauggcuggaacacuggcuguguuccuccuucucauaauggggcaauugacauggaaugaucugaucagauuaugcaucaugguuggagccaacgcuucugacaggauggggaugggaacgacguaccuagcucugauggccacuuuuaagaugagaccaauguuugcugucgggcuauuauuccguagacuaacauccagagaaguucuccuccuuacaauuggauugagucuaguggcaucuguggaguuaccaaauuccuuggaagagcugggggauggacuugcaaugggcauuaugauuuuaaaauuauugacugacuuucagccacaucagcugugggcuaccuugcuguccuugacauuuaucaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcucgcugggccacuaauagcuggaggcaugcuaauagcauguuauguuauaucuggaagcucagccgacuuaucauuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaauuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaaggaaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaagacaagaagauaucucccagccauaguccgugaggccauaaaaagaaagcugcgcacacuaauuuuggcucccacaagaguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccauuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaggacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugaguaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacucugggaaagacguauucuuuacaccaccugagagaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacggccggaugggauacaaggauaacggaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggcauccaacauacaaguggccauaaaccaagugagaagacuaauugggaaugagaauuaucuagauuacaugacaucaaugaagagauucaagaacgagggugaucccgaaggggcacucugguga

SEQ ID NO: 6049 - RNA, 9879 nt, Artificial Sequence
  derived and/or modified CDS sequence (wt) from DENV-1__GU131784__SS-prME
ucugugaccaugcuccuuauguugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccgacgcgacaaacgcuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccauuacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacaggggcuggggcaauggaugugggcucuucggaaagggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccaguuaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaacuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguauguggaauacgaucagcaacucgucucgagaacauuauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccaccuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcaccaugcguggaagacaauggccaugguacugucaauuguaucucucuuccccuuaugccuguccacgaccucccaaaaaacaacauggcuuccggugcuauugggaucucuuggaugcaaaccauuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucugggagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaagacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccucuugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccgggcaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaccaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccaugcggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucagaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaacuuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuucggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccaggagaguucucgacuggcuggaaaaacauggcguugaaaggcugaaaagaauggcaaucagcggagaugacugcguaguaaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6050 - RNA, 9879 nt, Artificial Sequence
  derived and/or modified CDS sequence (wt) from DENV-1__JF937612__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaucaagugggaaaugaaagcacagaacaugggacaacugcaacuauaacaccucaagcuccuacgacggaaauacagcugaccgacuacggagcucuuacauuggauuguucaccuagaacaggacuggacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaagccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacgccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucagggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacaaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuucuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuucaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugcccuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaagacaucuaucggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguaguaaaaccaauugaugauagguuugcaacagccuugacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6051 - RNA, 9879 nt, Artificial Sequence
  derived and/or modified CDS sequence (wt) from DENV-1__GU131786__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcuauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaccugccagaggagcccgaaggauggccauccugggagccaccgcaugggacuuugguucuauaggaggaguguucccgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucgggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaaaaaaaugauuaggccacaacccauggaguacaaauacucguggaaaagcuggggaaaagcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaggaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagccguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccaggggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcccacuggacagaagcaaaaaugcuccuugauaauauaaacacaccagaaggaauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuucuaucaggaagggggcuagggaaaacauccaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaaccauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccuccugaugcggacuacaugggcccugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccagggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacgacagaagacaugcugucaguguggaauaggguuuggauagaggaaaacccauggauggaggacaaaacccauauauccaguuggggagauguuccauauuuaggaaaaagggaagaucaauggugcggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6052 - RNA, 9879 nt, Artificial Sequence
  derived and/or modified CDS sequence (wt) from DENV-1__GU131787__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuuuggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcccgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugguaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggccaugguacugucaauuguaucucucuucccuuuaugccuguccacgaccucccaaaaaacaacauggcuuccgguguuauugggaucccuuggaugcaaaccacuaaccauguuucuuauagcggaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauauccggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguauuccacacaauguggcaugucaccaggggagcuguacucauguaucaagggaagagauuggaaccgagcugggccagugucaaaaaagaccugaucucauauggaggagguuggaggcuucaaggauccuggaacacaggggaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaccacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccauuauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaauuauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6053 - RNA, 9879 nt, Artificial Sequence
  derived and/or modified CDS sequence (wt) from DENV-1__HM181968__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggaucauuuucauuuuguuaaugcugguaacaccauccauggccaugcgaugcgugggaauaggcagcagggacuucguggaaggacugucaggagcaacuuggguagacguaguacuggaacauggaagcugcgucaccaccauggcgaaagacaaaccaacauuggacauugaacucuugaagacggaagucacaaacccugccguccugcgcaaacugugcauugaagccaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugccaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucaugguuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggagcaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucggucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucgcgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguacaacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuacuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucuuuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuggcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguucaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagcuacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucguuacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucaaguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauauuggaguucuuccuaauggugcugcuuauuccagagccagacaggcaacgcacuccgcaggacaaucagcuggcguauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagauuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagagguacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaauugauuggguuccaaccagucgcaccaccuggucgauccaugcccaccaccaauggaugacaacagaagacauguugucaguauggaauaggguguggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6054 - RNA, 9879 nt, Artificial Sequence
  derived and/or modified CDS sequence (wt) from DENV-1__GU131789__SS-prME
ucugugacaaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaggaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugauugaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucucauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacaacgccgggcacuuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguuuuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuggggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucaaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagcggaaccuugugaaaccagaagggaaagucauagaccucgguuguggaagagguggcuggucauacuacugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcucuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaauuuuagccgagagaguucucgacuggcuggaaaaauauggcgucgaaaggcugaaaagaauggcaaucagcggagaugauugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaauccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6055 - RNA, 9879 nt, Artificial Sequence
  derived and/or modified CDS sequence (wt) from DENV-1__GU131790__SS-prME
ucugugaccaugcuccuuaugcuggugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuggaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaacucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggagcuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggaguaacacuguucuuccuaucaggaaggggccuagggaaaacaucuaucggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacguguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauacauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucaaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuagggaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6056 - RNA, 9879 nt, Artificial Sequence
  derived and/or modified CDS sequence (wt) from DENV-1__GU131791__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugagcauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaauuuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggacccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauauugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuucacaggagagaccugagacuagccgcuaaugcuaucuguucggccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6057 - RNA, 9879 nt, Artificial Sequence
  derived and/or modified CDS sequence (wt) from DENV-1__GU131792__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagccuugggcccugagacacccaggauucacggugauagcccuuuuucuagcacaugccauaggaacauccaucacccagaaggggaucauuuucauuuuguuaaugcugguaacaccauccauggccaugcgaugcgugggaauaggcagcagggccuucguggaaggacugucaggagcaacuuggguagacguaguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaccuuugugugccgccgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugcccgacuacggagcucuuacauuggauugcucacccagaacaggacuggacuuuaaugaaaugguguuguugacaaugaaagaaaaaucaugguuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacuggguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaacgggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcccgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggacucaggauguguaauuaauuggaaaggaagagagcucaaauguggaaguggcaucuuuggcaccaaugaaguucacacuuggacagagcaauacaaauuucaagcugacuccccaaagagacuaucagcagccaucgggaagccaugggaggaggguguguguggaauucgaucagccacucggcucgagaauaucauguggaagcaaauaucaaaugaacugaaccacaucuuacuugaaaaugacaugaaauucacagugguugugggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacucccacacccaagugugugaccaccggcuaauggcagcugccaucaaggacaggaaggcaguucaugcugacaugggguacuggauagaaagugaaaagaacgagcccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugagguuuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguuggccaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagcuauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagauauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucguuacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauuaccagacaccauagaaacguugaugcuccuagcuuugauagcuguguugacugguggagugacgcuguucuuccuaucaggaaggggccuagggaaaacaucuaucggcuuacucugcgugauggcuucaagcguauugcuauggauggccaguguggagccccauuggauagcggccuccaucauacuggaguucuuccuaauggugcugcuuauuccagagccagacaggcaacgcacuccgcaggacaaucagcuggcguauguggugauagguuuguuauucaugauacugacaguagcagccaaugagaugggacuacuggaaacuacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagauuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgcuaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaaguguaguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6058 - RNA, 9879 nt, Artificial Sequence
  derived and/or modified CDS sequence (wt) from DENV-1__HM488256__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugcccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcccgaaggauggccauacugggagcccccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaagcaugggaggaggguguguguggaauucgaucagcaacucgucucgagaacaucauguggaagcaaauaucaaaugaacuaaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaagacagcaaggcaguucacgcugacaugggguacuggauagaaagugaaaagaacgagaccuggaagcuggcaagagccucuuucauagaaguuaaaacauguaucugggcaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagcccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacccuggcuguguucuuccuucucauagugggccaauugccauggaaugaucugaucagauuaugcaucaugguuggagccaccgcuuccgccaggauggggaugggaacgacgucccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugggacugucaguuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaagaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagauuuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccucauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaacccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacugggccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagcuggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaguauggcgucgaaaggcugaaaagaauggcaaucagcggagaugacugcguggugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6059 - RNA, 9879 nt, Artificial Sequence
  derived and/or modified CDS sequence (wt) from DENV-1__GU131793__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauugcugguguaaugccacagacacaugggugaccuauggaacauguucccaaacuggugagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaccacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagagcuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaccugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacugcgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagccggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuucccacagagcaacgcaguuauccaagaugaggaaagagacauuccugagagaucauggaacucaggcuaugaguggaucacugauuucccagguaaaacaguuugguuuguuccaagcauuaaaucaggaaaugacauugccaacuguuuaagaaagaaugggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacacuauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacaaacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccuuuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaaaggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguuaggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugauacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6060 - RNA, 9879 nt, Artificial Sequence
  derived and/or modified CDS sequence (wt) from DENV-1__GU131794__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccucauagcgauggaucugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacaacugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggagguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaaaaaaaugauuaggccacaacccauggaguacaaauacucguggaaaagcuggggaaaagcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggagcuaccaaauuccuuggaggagcugggggauggacuugcaaugggcauuaugauuuugaaauuguugacugauuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugccuuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcaucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaaucccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguagaaccagagguagccaaccuagauaucauuggccagaggauagagaacauaaaacaugaacauaagucaacauggcacuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaauauacaaguggccauaaaccaagugagaagacuacuugggaaugagaauuaucuagauuacaugacaucaaugaagagguucaagaaugagagugauccugaaggggcacucugguga

SEQ ID NO: 6061 - RNA, 9879 nt, Artificial Sequence
  derived and/or modified CDS sequence (wt) from DENV-1__GU131796__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacagacccugccguccugcguaaacugugcguugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaaugacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucugucggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggcuacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuacugacugacuuucaaucacaucaguugugggcuaccuugcuguccuugacauuuaucaaaacaacgucuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauccaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggcgaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagggaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggguggaaccuaguaaaacugcacuccgggaaagacguauucuuuauaccacccgagaaaugugacacccuuuugugugauauuggugaguccucuccaaacccaacuauagaggaaggaagaacgcuacgcguccuuaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaagccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcagcagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugucuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 6062 - RNA, 9879 nt, Artificial Sequence
  derived and/or modified CDS sequence (wt) from DENV-1__GU131797__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauugcugguguaaugccacagacacaugggugaccuauggaacauguucccaaacuggugagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaccugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacugcgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccugcuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuucugaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucacugauccaucaaguauagcggccagaggguacaucucaacccgagugggcaugggugaagcagcugcaaucuucaugacagccacucccccaggaucaguggaggccuucccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacacuauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacaaacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagaucuggacccugugguuuaugaugcaaaauuugaaaaacaacuaggccaaauaauguuguugauacuaugcacaucacagauccuuuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccugaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugggguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguuaggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugauacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccaacugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6063 - RNA, 9879 nt, Artificial Sequence
  derived and/or modified CDS sequence (wt) from DENV-1__GU131801__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguagagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucgacaucacaagagacuuggaauagacaagauuugcuggugacauuuaagacagcucaugcaaagaagcaggaaguagucguauuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaacauugaggcagaaccgccuuuuggugagaguuacaucgggauaggagcaggugaaaaagcuuugaaacuaagcugggucaagaaaggaaguagcauagggaaaaugguugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguauuuuugucaccaaugaaguucacaccuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauccauggaggaccaauaucucagcacaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaguugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacacuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgagauggcagaagcgcucaagggaaugccaauaagguaccaaacaacagcagugaagagugaacacacaggaaaagagauaguugaccucaugugucacgcuacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagaguaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacagacaucuccgaaaugggagcaaauuuccgggccgacagggugauagacccaagacggugucugaaaccgguaauauuaaaagaugguccagagcgugucauuuuggcaggaccgaugccagugacuguggccagugccgcccagaggagaggaagaauuggaaggaaccacaauaaggaaggugaucaguacaucuacaugggacagccuuuaaacaacgaugaggaucacgcucacuggacagaagcaaaaaugcuccuugauaauauaaacacaccagaagggauuaucccagcccucuuugagccggagagagaaaagagugcagcaauagacggggaauauagacugcggggugaagcaaggaaaacguuuguggagcucaugagaagaggagaccuaccugucuggcuguccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggauggccaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugugaauccaucacacuggccacuggaccucugaccacgcuuugggagggaucuccaggaaaauuuuggaacaccacgauagcgguuuccauggcaaacauuuuuagaggaaguuaucuagcaggagcagguuuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauacacaaaaggaggaccuggacaugaggaaccaaucccaauggcgaccuauggauggaaccuaguaaaacugcacuccgggaaagacguauucuucauaccaccugagaaaugugauacccuuuugugugauauuggugaguccucuccaaacccaacuauagaggaaggaagaacgcuacgcguucuaaagaugguggaaccauggcucagaggaaaccaauuuugcauaaagauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggggaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaauuuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 6064 - RNA, 9879 nt, Artificial Sequence
  derived and/or modified CDS sequence (wt) from DENV-1__GU131804__SS-prME
ucugugaccauguuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguugugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugacuugugugaggguaccacaguuguuguggaugaacauuguggaaaucgaggaccaucucuuaggaccacaacagucacaggaaagauaauucaugaaugguguugcagaucuugcacguuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagcugaccuaucauuagagaaagcggcugaggucuccugggaagaagaagcagaacacucuggugccucacacaauauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuacagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccagagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuaugucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccaugcggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaacauagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccaucggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucuaugaagagauucaagaacgagagugaucccgaaggggcacucugguga

SEQ ID NO: 6065 - RNA, 9879 nt, Artificial Sequence
  derived and/or modified CDS sequence (wt) from DENV-1__GU131805__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacagacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaaugacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgccggaaauacagcugcccgacuacggagcucuuacauuggauuguucaccuagaccaggacuagacuuuaaugaaaugguguuguugccaaugaaagaaaaaucauggcuaguccacaaacaaugguuucuagaccuaccacugccuuggaccucgggagcuucaacaucacaagagacuuggaacagaaaagauuugcuggggacauuuaagacagcucaugcaaaggagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccggcuuuuggugagaguuacaucgugauaggagcaggugaaaaagcuuugaaacuaagcugggucaagaaaggaagcagcauagggaaaauguuugaggcaacugccagaggagcacgaaggauggccauacugggagacaccgcaugggacuuugguucuauaggaggaguguucacgucugucggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaagugggauuuuuggcaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugccaugaaacucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagcccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuccaggaaagauaauucaugaaugguguugcagaucuuguacgcuaccacccuuacguuucaaaggagaagaugggugcugguacgguauggaaaucagcccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaccacugccuguguucuuccuucucauaaugggccaauugccauggaaugaucugaucagauuaugcaucaugguuggagccaacgcuuccgacaggauggggaugggaacgccguaccuagcucugauggcuacuuuuaaaaugagaccaauguuugcuguaggacuauuauuccgcagacuaacauccagagaaggacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuggccuugacauuuaucaaaacaacguuuuccuuggacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucugguggcucacacaacauauuaguggagguccaagaugauggaaccaugaagauaaaggaugaagagagagaugccacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguucguuccaagcaucaaaucaggaaaugacauugccaacugcuuaagaaagaaugggaaacgggugauccaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggcgaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagggaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggguggaaccuaguaaaacugcacuccgggaaagacguauucuuuauaccacccgagaaaugugacacccuuuugugugauauuggugaguccucuccaaacccaacuauagaggaaggaagaacgcuacgcguccuuaagaugguggaaccauggcuuagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaagccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcagcagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugucuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 6066 - RNA, 9879 nt, Artificial Sequence
  derived and/or modified CDS sequence (wt) from DENV-1__GU131806__SS-prME
ucugugaccauguuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaaaugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuuuuagaccuaccacuggcuuggaccucgggaggcucaacaucacaagagacuuggaacagacaagaucugguggugacauuuaagacagcucauggaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuagccaaguuggaacuggauuuugacuugugugaggguaccacaguuguuguggaugaacauuguggaaaucgaggaccaucucuuaggaccacaacagucacaggaaagauaauucaugaaugguguugcagaucuugcacguuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagcugaccuaucauuagagaaagcggcugaggucuccugggaagaagaagcagaacacucuggucccucacacaauauauuaguggaaguccaagaugauggacccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuacagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauauuaggucuuuauggaaauggaguagugacaacaaguggaaccuacgucagugccauagcucaagccagagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggggaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucuaugaagagauucaagaacgagagugaucccgaaggggcacucugguga

SEQ ID NO: 6067 - RNA, 9879 nt, Artificial Sequence
  derived and/or modified CDS sequence (wt) from DENV-1__GU131807__SS-prME
ucugugaccaugcuccuuaugcugaugccuacagccuuggcguuccauuugacuacacgagggggagagccgcacaugauugucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauugcugguguaaugccacagacacaugggugaccuauggaacauguucccaaacuggugagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagccggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucacccagaacaggacuagacuuuaaugaaaugguguuggugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaagggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaccugcauauggaguuuuguucagcgguguuuccuggcccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaccauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcugggucaggggaaguggacagcuuuucacuaggacuccuaugcauaucaauaaugaucgaggaggugaugagauccagauggaguagaaaaaugcugaugacuggaacacuggcuguguucuuccuucucauaaugggacaauugacauggaacgaccugaucagauuaugcaucaugguuggagccaacgcuuccgacaggauggggaugggaacgacguaccuagcccugauggccacuuuuaaaauuagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacugcgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuucccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacuguuuaagaaagaacgggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaagaacaaccagguguuggaggagaauauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacacuauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacaaacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccuuuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguuaggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugauacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6068 - RNA, 9879 nt, Artificial Sequence
  derived and/or modified CDS sequence (wt) from DENV-1__GU131811__SS-prME
ucugugaccaugcuccuuaugcugaugccuacagccuuggcguuccauuugacuacacgagggggagagccgcacaugauagucagcaagcaggaaagaggaaagucacuucuguuuaagaccucagcaggugucaacaugugcacccuuauagcuauggauuugggagaguuuugugaggacacaaugacuuacaagugcccucgaaucacugaggcggaaccagaugacguugauuguuggugcaaugccacagacacaugggugaccuauggaacauguucccaaauuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacauugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccugccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacaacaacaauuuuugcaggacacuugaaauguagacuaaagauggacaagcugacucuaaaagggaugucauauguaaugugcacaggcucauucaagcuagagaaagaaguggcugagacccagcauggaaccguucuaguacagauuaaauaugaaggaacagaugcaccaugcaagaucccuuuuucgacucaagaugaaaaaggagugacccagaaugggagacuaauaacagcuaaccccauagucacugacaaagagaaaccagucaacauugaggcagaaccgccuuuuggugagaguuacaucgugauaggaguaggugaaaaagcuuugaaacuaagcugguucaagaaaggaagcagcauagggaaaauguuugagacaacugccagaggagcacgaaggauggccauacugggagacaccgcaugggacuuugguucuauaggaggaguguucacgucuguuggaaaauuaguacaccagauuuuuggaacugcauauggaguucuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaguacaaauacucguggaaaagcuggggaaaagcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaacggaguucuggaaagugaaaugauaauuccgaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuccucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccaugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguucaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaguaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccggccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccaggggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacgguguuugaaaccgguaauacuaaaagaugguccagagcgugucauuuuagcaggaccgaugccagugacuguggccagugccgcccagaggagaggaagaauuggaaggaaccauaauaaggaaggugaccaguacaucuacaugggacagccuuuaaacaacgaugaagaucaugcucacuggacagaagcaaaaaugcuccuugauaauauaaacacaccagaaggaauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagcuuauagacaugcaauggaagaacugccagacaccauagaaacguugaugcuccuagcuuugauagcuguguuaacugguggagugacgcuguucuuccuaucaggaagggggcuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaaccauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggcccugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagagcucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6069 - RNA, 9882 nt, Artificial Sequence
  derived and/or modified CDS sequence (wt) from DENV-1__JF937615__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacagacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaaugacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucaacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacugggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacagacucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucugucggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucaacacaacuacagaccaggauauuucacacaaacggcagggccguggcaccuaggcaaguuggaacuggauuuugauuugugugaggguaccacuguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggcuacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcaucaugauuuuaaaauuauugauugacuuucaaucacaucaguugugggcuaccuugcuguccuugacauuuaucaaaacaacguuuuccuugcacuaugcauggaagacaauggccaugguacugucaauuguaucucucuuccccuuacugccuguccacgacuuacccaaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauccaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggcgaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugauguuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggguggaaccuaguaaaacugcacuccgggaaagacguauucuuuauaccacccgagaaaugugacacccuuuugugugauauuggugaguccucuccaaacccaacuauagaggaaggaagaacgcuacgcguccuuaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcagcagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 6070 - RNA, 9879 nt, Artificial Sequence
  derived and/or modified CDS sequence (wt) from DENV-1__GU131814__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacuccugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucucauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccucaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacaacgccgggcacuuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguuuuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuggggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacaucucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagcggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacaugagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacgucaaugaagagauucaagaacgagagugaucccgaaggggcacucugguga

SEQ ID NO: 6071 - RNA, 9879 nt, Artificial Sequence
  derived and/or modified CDS sequence (wt) from DENV-1__GU131815__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaauuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgccuggaaacagauacaaagaguggaaacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaagacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggauaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauuguuacugacaaagaaaaaccagucaacauugaggcagaaccgcccuuuggugagaguuacaucacaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacguggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcgugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacccuauggagcaauggaguucuggaaagugaaaugauaauuccaaagaucuauggaggaccaauaucucagcacaacuacagaccaggauauuuuacacaaacagcagggccguggcaccuaggcaaauuggaacuggauuuugauuugugugaggguaccacaguuguuguggaugaacauuguggaaaucgaggaccaucucuuaggaccacaacagucacaggaaagauaauucaugaaugguguugcagaucuugcacacuaccacccuuacguuucagaggagaagaugggugcugguacgguauggaaaucagaccagucaaggaaaaggaagaaaaucuagucaagucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggaguugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccuuaaugaaggaaucauggcuguuggaauagucagcauccuacuaaguucacuccucaaaaaugauguaccgcuagcugggccacuaauagcuggaggcaugcuaauagcauguuauguuauauccggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcagcuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccggguaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguguagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagcccuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccaggugcuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacgcugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcugcugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccuggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcgucuuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaggcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaagccagaauuacugacaucauggaacccgaacaugcccuacuggcuaagucaaucuucaaguuaaccuaccaaaauaaggugguaaggguacagagaccagcaaaaaauggaaccgugauggaugucauauccaggcgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaagguugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6072 - RNA, 9879 nt, Artificial Sequence
  derived and/or modified CDS sequence (wt) from DENV-1__GU131818__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaaaaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaagcugcgucaccaccauggcaaaagacaaaccaacauuggacauugaacucuugaagacggaagucacaaacccugccguccugcguaaauugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguccaacaugaaaacuugaaauauucaguaauagucaccguccacacuggagaccagcaccaggugggaaaugaaaguacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaagcugacucuaaaagggacgucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcugaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaacuccuuggaggagcugggggauggacuugcaaugggcauuaugauuuuaaaauuauugacugacuuucaaucacaucaguugugggcuacccugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuacagaauuaugcagagaggacuguugggcaggucccaaguaggaguaggaguuuuucaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggccuuuacggaaacggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguucgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaagacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguauaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagcuuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugguacuaugcacaucacaaauccucuugaugcggacuacaugggcuuugugugaauccaucacacuagccacuggaccucugaccacgcuuugggagggaucuccaggaaaauuuuggaacaccacgauagcgguuuccauggcaaacauuuucagaggaaguuaucuagcaggagcaagucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaaaucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaaugcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugccuuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugaggaaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugaaagaaacugcaugccuaggcaagucauaugcacaaauguggcaguugauguacuuccacaggagagaccugagacuagccgccaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6073 - RNA, 9879 nt, Artificial Sequence
  derived and/or modified CDS sequence (wt) from DENV-1__GU131820__SS-prME
ucagugaccaugcuacuuaugcugaugcccacagccuuggcguuccaucugacuacacgagggggagagccacauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggcuaugcgaugcgugggaauaggcaguagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcaaauccuauagucacugacaaagaaaaaccagucaacauugaggcagaaccgcccuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccucguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacacccccgaaugcccugaugaucaaagggcauggaacauuugggaaguugaggacuauggauuuggaauuuucacgacaaauauaugguugaaauugcgugacuccuacacucaagugugugaccaccggcuaaugucagcugccaucaaggacagcaaggcaguccaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuucaaaggagaagauggguguugguacgguauggaaaucagaccaguuaaggaaaaggaagagaaucuagucaaaucaauggucucugcaggguuaggggaaguggacagcuuuucacuaggacugcuaugcauaucaauaaugaucgaagaggugaugagauccagauggaguagaaaaauguugauggcuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaagaugagaccaauguuugcugucgggcuauuauuccguagacuaacauccagagaaguucuccuccuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuaucaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcucgcugggccacuaauagcuggaggcaugcuaauagcauguuauguuauaucuggaagcucagccgacuuaucauuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaauuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaaggaaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaagacaagaagauaucucccagccauaguccgugaggccauaaaaagaaagcugcgcacacuaauuuuggcucccacaagaguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccauuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggccucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaggacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugaguaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacucugggaaagacguauucuuuacaccaccugagagaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacggccggaugggauacaaggauaacggaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggcauccaacauacaaguggccauaaaccaagugagaagacuaauugggaaugagaauuaucuagauuacaugacaucaaugaagagauucaagaacgagggugaucccgaaggggcacucugguga

SEQ ID NO: 6074 - RNA, 9879 nt, Artificial Sequence
  derived and/or modified CDS sequence (wt) from DENV-1__HM181970__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaucgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcuaaccgacuacggagcucuuacauuggauuguucaccuagaacaggacuagacuuuaaugaaaugguguuguugacaaugaaggaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcaugggaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguucugcugacauggcuaggauuaaacucaaggagcacgucccucucgaugacgugcauugcagucggccuaguaacgcuauacuuaggagucaugguucaggcggauucaggaugcguaauuaacuggaaagguagagaacucaaauguggaaguggcauuuuuguuaccaaugaaguucauaccuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuucgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaauauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaagacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggccaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggcugacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacagggaggaagagccuauagacaugcaauggaagaacugccagacaccauagaaacguuaaugcuccuagcuuugauagcuguguuaacugguggagugacgcuguuuuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuacucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucccuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugagaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguuuugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcggaugacacagccggaugggauacaaggauaacagaggaugaccuucagaaugaggccaaaauuacugacaucauggaacccgaacacgcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcagcaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacagaagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 6075 - RNA, 9879 nt, Artificial Sequence
  derived and/or modified CDS sequence (wt) from DENV-1__GU131821__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaaaaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaauugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguccaacaugaaaacuugaaauauucaguaauagucaccguccacacuggagaccagcaccaggugggaaaugaaagcacagagcaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacugguacacuggccguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaacuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaauauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugaucgcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaggacaaccagcuggcauauguagugauagguuuguuauucaugauacugacaguagcagccaaugagaugggacugcuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugugaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggggaaacaaccaaacacgcagugucgagaggaacagcuaaacugaggugguuuguggagaggaaucuugugaaaccagaagggaaagucauagaccuugguuguggaagagguggcuggucauacuauugcgcugggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaucuaggcgccggaacaagacauguggcaguggaaccugagguagccaaccuagauaucauuggccagaggauagagaacauaaaacaugaacauaagucaacauggcauuaugaugaggacaacccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugagugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6076 - RNA, 9879 nt, Artificial Sequence
  derived and/or modified CDS sequence (wt) from DENV-1__JF937617__SS-prME
ucugugaccaugcuccuuaugcugaugccuacagccuuggcguuccauuugacuacacgagggggagagccgcacaugguagucagcaagcaggaaagaggaaaaucacucuuguucaagaccucagcaggugucaacaugugcacccuuauagcgauggauuugggagaguuaugugaggacacaaugacuuacaaaugcccucgaaucacugaagcugaaccagaugacguugacuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggagauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagaccuggaacagacaagauuugcuggugacauuuaagacagcucaugcaaagaagcaggaaguagucgugcuaggaucacaagaaggagcaaugcacacugcguugaccggagcaacagaaauccaaacgucaggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggauuagggguucugcugacauggcuaggauuaaacucaaggagcacgucccuuucgaugacgugcauugcaguuggccuaguaacacuauacuuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacgucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucaugggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaucaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacugguuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacagacuuucaaucacaucagcugugggccaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauccuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaaguacaggugauugcuguugaaccagggaaaaaccccaaaaauguacaaacagcgccgggcaccuuuaagaccccugaaggugaaauuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaaguauuaaaucaggaaaugacauagccaacugccuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgaaccggagagggaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacgaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuucuuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaaaaaagacuuagggauuggccaugcggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccccugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacaguugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaagugagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacauguugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaacuaccuagauuacaugacaucaaugaagagauucaagaacgagagugaucccgaaggggcacucugguga

SEQ ID NO: 6077 - RNA, 9879 nt, Artificial Sequence
  derived and/or modified CDS sequence (wt) from DENV-1__JF937618__SS-prME
ucugugacaaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucucauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugauuucauauggaggagguuggaggcuucaaggauccuggaacacaggagaagaagugcaggugauugcuguugaaccagggaaaaaccccagaaauguacaaacaacgccgggcacuuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugacaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggacggccaguguggagccccauuggauagcggccuccaucauacuggaguuuuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuggggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucaaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagcggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcuguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcaaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6078 - RNA, 9879 nt, Artificial Sequence
  derived and/or modified CDS sequence (wt) from DENV-1__JF937619__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguggagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucgacaucacaagagacuuggaauagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcucgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuaguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauccauggaggaccaauaucucagcacaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaguugacauggaaugaucugaucagauuaugcaucaugguuggagccaacgcuuccgacagaauggggaugggaacgacguaccuagcucugauggucacuuuuaaaaugagaccaauguuugcuguagggcuuuuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcucuccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccuaaaaaaugaugugccgcuagcugggccacuaauagcuggaggcaugcuaauagcaugcuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacacuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgagauggcagaagcgcucaagggaaugccaauaagguaccaaacaacagcagugaagagugaacacacaggaaaagagauaguugaccucaugugucacgcuacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagaguaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaaaaaaaaauaacgacugggacuacgucgucacaacagacaucuccgaaaugggagcaaauuuccgggccgacagggugauagacccaagacggugucugaaaccgguaauauuaaaagaugguccagagcgugucauuuuggcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccggagagagaaaagagugcagcaauagacggggaauauagacugcggggugaagcaaggaaaacguuuguggagcucaugagaagaggagaccuaccugucuggcuguccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggauggccaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugauuuaugaugcaaaauuugagaaacaacuaggccaaauaauguuguugauacuaugcacaucacagauccucuugaugcggacuacaugggcccugugugaauccaucacacuggccacuggaccucugaccacgcuuugggagggaucuccaggaaaauuuuggaacaccacgauagcgguuuccauggcaaacauuuuuagaggaaguuaucuagcaggagcagguuuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuucauaccaccugagaaaugugauacccuuuugugugauauuggugaguccucuccaaacccaacuauagaggaaggaagaacgcuacgcguucuaaagaugguggaaccauggcucagaggaaaccaauuuugcauaaagauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguagaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaccacugguucagcagagagaauucacucagcggaguggaaggggaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaauuuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 6079 - RNA, 9879 nt, Artificial Sequence
  derived and/or modified CDS sequence (wt) from DENV-1__GU131827__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagaugcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacauuguaauaggagcaggugaaaaagcuuugaaacuaagcugguucaggaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguaggccuaguaacacuauaccuaggagucaugguucaggcggauucaggaugugcaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuagguaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauuaggaucccuuggaugcaaaccacuaaccauguuucuuauagcagaaaacaaaaucuggggaaggagaaguuggccccucaaugaaggaaucauggcuguuggaauagucagcaucuuacuaaguucacuccuuaaaaaugauguaccgcuagcugggccacuaauagcuggaggcaugcuaauagcauguuauguuauaucuggaagcucagccgaccuaucauuagagaaagcggcugaggucuccugggaagaagaagcggaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagcaaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauugucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaggaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguggcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccccugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuuguauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcucagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccauaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6080 - RNA, 9879 nt, Artificial Sequence
  derived and/or modified CDS sequence (wt) from DENV-1__GU131831__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggaugucuucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccacuaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucaugguuaguccacaaacaaugguuuuuagaccuaccacuaccuuggaccucgggagcuucaacaucacaagagacuuggaacagacaagaucugcuggugacauuuaagacagcucaugcaaagaagcaggaaguagucgugcuaggaucacaagaaggagcaaugcacacugcguugaccggagcgacagaaauccaaacgucuggaacgacaacaauuuuugcaggacacuugaaaugcagacuaaagauggacaaacugacucuaaaagggauaucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacagcccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuuaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagccuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugauacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggauacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuaugucagugccauagcucaagccaaagcaucacaagaagggccccuaccagagauugaagacgagguguucaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacauacaggaaaagagauaguugaccuaaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguagaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaacuuaccaaaauaaggugguaaggguacagagaccagcaaaaaauggaaccgugauggauguuauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauuggaucccaaccagccguaccaccuggucgauccaugcccaucaccaauggaugacgacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6081 - RNA, 9879 nt, Artificial Sequence
  derived and/or modified CDS sequence (wt) from DENV-1__EU482789__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacauccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaaauggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacagguucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguucuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacauuuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaagacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaagagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuuggcuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaguggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6082 - RNA, 9879 nt, Artificial Sequence
  derived and/or modified CDS sequence (wt) from DENV-1__EU482790__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggaucuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagauguaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccacuagcugggccacuaauagcuggaggcaugcuaauagcauguuauguuauaucuggaagcucagccgaccuaucacuagagaaagcagcugaggucuccugggaagaagaagcagaacacucuggcgccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcguaucaggugaucuaauauuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauugaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacuguacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguacccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaucuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaagaguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6083 - RNA, 9879 nt, Artificial Sequence
  derived and/or modified CDS sequence (wt) from DENV-1__EU482791__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaaggaaaaaaaaugauuaggccacaaccuauggaacacaaauacucguggaaaagcuggggaaaagcuaaaaucauaggggcagacguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuacagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuuuagaggaaguuaucuagcaggagcaggucuggccuucucauuaaugaaauccuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaacuagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcagaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgaaaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6084 - RNA, 9879 nt, Artificial Sequence
  derived and/or modified CDS sequence (wt) from DENV-1__EU482792__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugagacggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuuuuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaaugguugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagagagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaccgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcuguugggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucucauagcagaaaacaaaaucuggggaaggaaaaguuggccccucaaugaaggaaucauggcuguuggaguagucaguauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcuacgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccaggcaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacuacaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaaaucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaauauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguagugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgccaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6085 - RNA, 9879 nt, Artificial Sequence
  derived and/or modified CDS sequence (wt) from DENV-1__EU482707__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcuacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauugugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaagcucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 6086 - RNA, 9879 nt, Artificial Sequence
  derived and/or modified CDS sequence (wt) from DENV-1__EU482708__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaagucgccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauaucagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6087 - RNA, 9879 nt, Artificial Sequence
  derived and/or modified CDS sequence (wt) from DENV-1__EU482709__SS-prME
ucugugaccaugcuccuuaugcuggugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuggacuuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucacuaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacuuuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugaguuuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaaaggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggaucauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguauucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguagccauaaaccaagugagaagacuaauugggaaugagaauuaucuagauuacaugacaucaaugaagagauucaagaacgagagugaucccgaaggggcacucugguga

SEQ ID NO: 6088 - RNA, 9879 nt, Artificial Sequence
  derived and/or modified CDS sequence (wt) from DENV-1__EU482710__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguucuguucagcgguguuuccuggaccaugaaaauaggaauagggguucugcugacauggcuaggauuaaauucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcgugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaacacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaaccacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuugcacgcuaccacccuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcaucuuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggaggcuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccauugugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagcccuuaaacaacgacgaagaucacgcucacuggaccgaagcaaaaaugcuccuugauaauauaaacacaccagaagggauuaucccagcccucuuugagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauaucagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuugcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuauugcaauagauuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugcgacacccuuuugugugauauuggugaguccucuccaaacccaaccauagaagaaggaagaacguuacgcguccuaaaaaugguggaaccauggcucagagggaaccaauuuugcauaaaaauucugaaucccuacaugccaagugugguggaaacucuggaacaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaaguaagaagacuaauugggaaugagaauuaucuagauuacaugacaucaaugaagagauucaagaacgagggugaucccgaaggggcacucugguga

SEQ ID NO: 6089 - RNA, 9879 nt, Artificial Sequence
  derived and/or modified CDS sequence (wt) from DENV-1__EU482712__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaacagaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaagggguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaucaccggcuaaugucagcugccaucaaggacagcaaggcaguucacgcugacaugggguacuggauagaaagugaaaagaacgagaccuggaagcuggcaagagccuccuucauagaaguuaaaacauguaucuggccaaagucccacacucuauggagcaauggaguucuggaaagugaaaugauaauuccaaagaacuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcugugcucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacaacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaacuaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaaccuaacaauaauggaccuacauccaggaucggggaaaacaagaagauaucuuccagccauaguccgugaggccauaaaaaggaagcugcguacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacuccuccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaagcuuccacaacacuugacgcaaagggcccagaacgccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacguugacagcggcgguguugaugcuaguggcucauuacgccauaauuggaccuggacugcaagcaaaagcuacuagagaagcucaaaaaaggacagcggccggaauaaugaagaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaccuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucaucuauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguuuacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggacacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaagagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaaguuagaagacuaauugggaaugagaauuaucuagauuacaugacaucaaugaagagauucaagaacgagagugauccugaaggggcacucugguga

SEQ ID NO: 6090 - RNA, 9879 nt, Artificial Sequence
  derived and/or modified CDS sequence (wt) from DENV-1__EU249490__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucggaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacuccugaagacggaagucacaaacccugccguccugcguaaacugugcauugaagcuaaaauaucaaauaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagagcuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagccgaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacagggaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaagaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcaguaucgagaggaacagcuaaacugaggugguuuguggagaggaaucuugugaaaccagaagggaaagucauagaccucgguuguggaagagguggcuggucauacuacugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcgaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucaguggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugaucaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6091 - RNA, 9879 nt, Artificial Sequence
  derived and/or modified CDS sequence (wt) from DENV-1__EU249491__SS-prME
ucugugaccaugcuccuuaugcugaugccuacagccuuggcauuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagccaugguucaggcagauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagaggggcugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 6092 - RNA, 9879 nt, Artificial Sequence
  derived and/or modified CDS sequence (wt) from DENV-1__EU249492__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacgaaacuggaaggaaagauaguccaauaugaaaacuugaaauauucaguaauagucaccguccacacaggagaccagcaccaggugggaaaugaaagcacagaacaugggacaacugcaacuauaacaccucaagcuccuucaacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcguugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaguuaguacaccagauuuuuggaacugcauauggaguuuuguucagcgguguuuccuggaccaugaaaauaggaauaggaguucugcugacauggcuaggacuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagacguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaaaugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagaucuagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaacuccuuggaggagcugggggauggacuugcaaugggcauuaugauuuugaaauuauugacugacuuucaaucacaucaguugugggcuaccuugcuguccaugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgacuuaucacuagagaaagcagcugaggucuccugggaagaagaagcagaacacucuggugccucacacaacauauuaguggaaguccaagaugauggaaccaugaagauaaaggaugaagagagagaugacacgcuaaccauucuccucaaagcaacucugcuagcaguuucagggguguacccauuaucaauaccagcaacccuuuuugugugguacuuuuggcagaaaaagaaacagagaucuggaguguuaugggacacaccuagcccuccagaagugcaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaggcaucacaggaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcguguuauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggagaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagauuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaggcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggaaguaggagaggcacgggagcccaaggggaaacacugggagagaaauggaaaagacagcugaaccaacugaguaagucagaauucaacacuuauaaaaggagugggaucauggaaguggacagauccgaggccaaagagggacugaaaagaggagaaacaacaaaacaugcagugucgagaggaacagcuaaacugaggugguuuguggagaggaaucuugugaaaccagaagggaaagucauagaccucgguuguggaagagguggcuggucauauuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucaugugggacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauacaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacauguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagauaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugguccugaaggggcacucugguga

SEQ ID NO: 6093 - RNA, 9879 nt, Artificial Sequence
  derived and/or modified CDS sequence (wt) from DENV-1__EU249493__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauugcuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgauuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacaugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaauggugcugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacauuuuccuugcacuaugcauggaagacaauggccaugguacugucaauuguaucucucuuccccuuaugccugucuacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaaggggaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcggcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucuaguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuacgcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggaucccgugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaacucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagauacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6094 - RNA, 9879 nt, Artificial Sequence
  derived and/or modified CDS sequence (wt) from DENV-1__EU249494__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcucuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugcuguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcauugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagccaugguucaggcggauucaggauguguaauuaauuggaaagguagagagcucaaauguggaaguggcauuuuugucaccaacgaaguucacacuuggacagagcaauacaaauuucaagcugacuccccaaagagauuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucucacaauuggauugagucuaguagcaucuguggaguuaccaaauuccuuggaggagcugggggauggacuugcaaugggcauuaugauuuuaaaauuacugacugacuuucagucacaucagcugugggcuaccuugcuguccuugacauuuaucaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccucuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagcuagaggguacaucucaacccgagugggcaugggugaggcagcugcgaucuucaugacagccacucccccaggaucaguggaggccuuuccacagagcaaugcagucauccaagaugaggaaagagacauuccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacauauccgagaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuauguacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaagucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagauguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuauaacaugauggggaagagagagaaaaagcuaggagaguucggaaaggcaaaagggagucgugcaauaugguacaugugguugggagcacguuuucuagaguucgaagcucuugguuucaugaaugaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggacgaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuucacccagcgaauuggagaucccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuucuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccucuaacauacaaguggccauaaaccaagugagaagacuaauugggaaugagaauuaucuagauugcaugacaucaaugaagagauucaagaacgagggugaucccgaaggggcacucugguga

SEQ ID NO: 6095 - RNA, 9879 nt, Artificial Sequence
  derived and/or modified CDS sequence (wt) from DENV-1__EU249495__SS-prME
ucugugaccaugcugcuuaugcugaugcccacagccuuggcguuccaucugacuacacgagggggagagccgcauaugauaguuaccaagcaggaaagaggaaagucacuuuuguuuaagaccacagcaggcgucaacaugugcacccuuauagcgauggauuugggagaguuaugugaggacacaaugacuuacaaaugcccucggaucacugaggcggaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacacaaccuucaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggagagugaaaugguaauuccaaaaaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagcugacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagguccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacucgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacacuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaauuuguacaagagaggaguucacaaggaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6096 - RNA, 9879 nt, Artificial Sequence
  derived and/or modified CDS sequence (wt) from DENV-1__EU482794__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuagccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaggauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguauugucaauugcaucucucuuccccuuaugccuguccacgaccucccaaaaaacaacguggcuuccggugcuauugggaucucuuggaugcaaaccacuaaccauguuucuuauaacagaaaccaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggugguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaagccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacgacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaacuacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguacuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcggccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggaggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaauccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6097 - RNA, 9879 nt, Artificial Sequence
  derived and/or modified CDS sequence (wt) from DENV-1__EU482795__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucggaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacuccugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaaccauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuuucaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagagcuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucuccuucccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagccgaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaagaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcaguaucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcgaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6098 - RNA, 9879 nt, Artificial Sequence
  derived and/or modified CDS sequence (wt) from DENV-1__EU482796__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcaauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggccgagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuauuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagggagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagaugugcagaacaccaccuucaucaucgacggcccaaacaccccagaaugcccugaugaucaaagagcauggaacauuugggaaguugaggacuauggauuuggaauuuucacgacaaauauaugguugaaaaugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguaggaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaagagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucauccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaauuauggcuguuggaguagucagcauccuacuaaguucacuucucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuucugaaauggcagaggcgcucaagggaaugccaauaagguaccaaacaacagcagugaagagugaacacacaggaaaagagauaguugaccucaugugccacgccacuuucaccaugcgucuccugucccccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagccguguugacugguggagugacgcuguucuuccuaucaggaaggggccuagggaaaacaucuaucggcuuacucugcgugauggcuucaagcguacugcuauggauggccaguguggaaccccauuggauagcggccuccaucauacuggaguucuuccuaauggugcugcuuauuccagagccagacagacaacgcacuccgcaggacaaucagcuagcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucucgccuugggaugcuauucacaggugaauccacugacgcugacagcggcgguauugaugcuaguggcucacuacgccauaauuggaccuggauugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccauuacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugacauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaaaagacguggaccuaggcgcuggaacuagacauguggcaguggaaccagaaguagccaaccuggauaucauuggccagaggauagagaacauaaaacaugagcacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagugcaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugaaaaaagagagggagcuucacaaacagggaaaaugugccacguguguuuacaacaugauggggaagcgagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaacauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaacugugauggaugucauauccagacgugaccaaagaggaaguggccaggucggaacuuauggcuugaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaaggaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6099 - RNA, 9879 nt, Artificial Sequence
  derived and/or modified CDS sequence (wt) from DENV-1__EU482797__SS-prME
ucugugaccaugcuccuuaugcugaugccuacagccuuggcguuccauuugacuacacgagggggagagccgcacaugauagucagcaagcaggaaagaggaaagucacuuuuguuuaagacuucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccccugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguuuuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaaccuauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuuuauagaaguuaaaacauguaucuggccaaagucccacacucuauggagcaauggaguucuggaaagugaaaugauaauuccaaaaaucuauggaggaccaauaucucagcacaacuacagaccaggauauuucacacaaacggcagggccguggcaccuaggcaaguuggaacuggacuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacgaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagggacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaauacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauguaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6100 - RNA, 9879 nt, Artificial Sequence
  derived and/or modified CDS sequence (wt) from DENV-1__EU482799__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacacuugaagugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauaguuacugacaaagaaaaaccagucaacauugaggcagaaccgcccuuuggugagaguuacaucauaauaggagcaggugaaaaaacuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuucuuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaaucaauuggaaagguagagaacucaaauguggaaguggcauuuuugucaccaaugaaauucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucuaaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccagugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacauccggaucucccaucgugaacagagagggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgucuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggugaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcucugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccggagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6101 - RNA, 9879 nt, Artificial Sequence
  derived and/or modified CDS sequence (wt) from DENV-1__EU482800__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggccagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccauugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagagcaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucaguaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaaguuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuacgcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaagaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugccacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaacgagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcugugcuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccauugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacucugggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaaugguucacaggaaaccaacguaugaaagagacguggaccuaggcgccggaacaagacauguggcaguggaaccugagguagccaaccuagauaucauuggccagaggauagagaacauaaaacaugaacauaaaucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguuuucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6102 - RNA, 9879 nt, Artificial Sequence
  derived and/or modified CDS sequence (wt) from DENV-1__EU482801__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcaaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6103 - RNA, 9879 nt, Artificial Sequence
  derived and/or modified CDS sequence (wt) from DENV-1__EU482802__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucggaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacuccugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaaccauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagagcuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucuccuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagccgaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaagaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcaguaucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaaucgaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6104 - RNA, 9879 nt, Artificial Sequence
  derived and/or modified CDS sequence (wt) from DENV-1__EU482804__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagguaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauucaagacagcucaugcaaagaagcaggaaguagucguacuaggaucacaagaaggagcaaugcacacugcguugaccggagcaacagaaauccaaacgucuggaacgacaacaaucuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggaugugugauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggagggcguguguggaauacgaucaacaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaacgggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacaaagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacagacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcugcugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccuugguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaauccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgauucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6105 - RNA, 9879 nt, Artificial Sequence
  derived and/or modified CDS sequence (wt) from DENV-1__EU482806__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggauacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuucaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagucaugguucaggcggauucaggauguguaauuaauuggaaagguagagagcuaaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauauggcugaaauugcgugacucuuacacccaagugugugaccaucggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaucuagcucugauggccacuuuuaaaaugagaccaauguuugcugucgggcuauuauuccguagacuaacauccagagaaguucuccuucucacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuaucaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcaccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcuccuacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaggcagcugcgaucuucaugacagccacucccccaggaucaguggaggccuuuccacagagcaaugcaguuauccaagaugaggaaagagacauuccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccaaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuccgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgcgaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauucccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuucacccugcgaauuggagauuccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggcaaccugggccucuaacauacaaguggccauaaaccaagugagaagacuaauugggaaugagaauuaucuagauuacaugacaucaaugaagagauucaagaacgagggugaucccgaaggggcacucugguga

SEQ ID NO: 6106 - RNA, 9879 nt, Artificial Sequence
  derived and/or modified CDS sequence (wt) from DENV-1__EU482807__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuguagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcguauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaauaggacaauugacauggaaugacuugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauucaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguauccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacacuauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaagagccaauuccaauggcgaccuauggauggaaccuaguaaaacugcacuccgggaaagacguguucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcgaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagauuauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6107 - RNA, 9879 nt, Artificial Sequence
  derived and/or modified CDS sequence (wt) from DENV-1__EU482808__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugugucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggggcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugagccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuaugcugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauauuauugcgccgggcugaagaaagucacagaagugaagggauauacgaaaggaggaccuggacaugaggagccaauuccaauggcgaccuauggauggaaccuaguaaaacugcacuccgggaaagacguauucuuuacaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagagacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6108 - RNA, 9879 nt, Artificial Sequence
  derived and/or modified CDS sequence (wt) from DENV-1__EU482809__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugccaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuaguacagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacacuccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagccguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucgggaaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggcuagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagauaucuccgaaaugggagcaaauuuccgggccgauagggugauagacccaagacggugucugaaaccgguaauacuaaaagaugguccagagcgugucauuuuagcaggaccgaugccagugacuguagccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaaucaucacucccaugaugaggcacacaauugaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagagaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6109 - RNA, 9879 nt, Artificial Sequence
  derived and/or modified CDS sequence (wt) from DENV-1__EU482810__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacgaaacuggaaggaaagauaguccaauaugaaaacuugaaauauucaguaauagucaccguccacacaggagaccagcaccaggugggaaaugaaagcacagaacaugggacaacugcaacuauaacaccucaagcuccuucaacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcuggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacagccagaggagcacgaaggauggccauacugggagacaccgcaugggacuuugguucuauaggaggaguguucacgucuguuggaaaguuaguacaccagauuuuuggaacugcauauggaguuuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagacguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuauacccaaaugugugaccaccgguuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuuuacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagaucuagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaacuccuuggaggagcugggggauggacuugcaaugggcauuaugauuuugaaauuauugacugacuuucaaucacaucaguugugggcuaccuugcuguccaugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgacuuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaagugcaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaggaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcguguuauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuaucccacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagauuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagcuauugcaaaccaggcggccauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaggcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggaaguaggagaggcacgggagcucaaggggaaacacugggagagaaauggaaaagacagcugaaccaacugaguaagucagaauucaacacuuauaaaaggagugggaucauggaaguggacagauccgaagccaaagagggacugaaaagaggagaaacaacaaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucaugugggacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauacaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuccuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacauguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucauugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagauaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugguccugaaggggcacucugguga

SEQ ID NO: 6110 - RNA, 9879 nt, Artificial Sequence
  derived and/or modified CDS sequence (wt) from DENV-1__EU482811__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguggagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacauguauuuggccaaaaucccacacucuauggagcaauggaguucuggaaagugaaaugauaauuccaaagauccauggaggaccaauaucucagcauaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaguugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaaucuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaagcgcucaagggaaugccaauaagguaccaaacaacagcagugaagagugaacacacaggaaaagagauaguugaccucaugugucacgcuacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagagcaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacggacaucuccgaaaugggagcaaauuuccgggccgacagggugauagacccaagacggugucugaaaccgguaauauuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccggagagagaaaagagugcagcaauagacggggaauauagacugcggggugaagcaaggaaaacguuuguggagcucaugagaagaggagaccuaccugucuggcuguccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggauggccaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugcgaauccaucacacuggccacuggaccucugaccacgcuuugggagggaucuccaggaaaauuuuggaacaccacgauagcgguuuccauggcaaacauuuuuagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaagauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagcuaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggggaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccugcuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaauuuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugacugggucccaaccagccgcaccaccuggucgauccaugcccaucaccaauggaugacaacagaagacaugcugucaguguggaauagggucuggauagaggaaaacccauggauggaggacaaaacccguauauccaguugggaagauguuccauaucuaggaaaaagggaagaucaaugguguggaucucugauaggcuuaacugcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 6111 - RNA, 9879 nt, Artificial Sequence
  derived and/or modified CDS sequence (wt) from DENV-1__EU482812__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaaccgcaacuauaacaccucaagcuccuacgacggaaauacagcugaccgacuacggagcucuuacauuggauugcucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggagcaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccaaguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggcuuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagauguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaaucugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagcugcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6112 - RNA, 9879 nt, Artificial Sequence
  derived and/or modified CDS sequence (wt) from DENV-1__EU482813__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauacucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauaccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaagaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucaaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagaacaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaagaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccugaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggacggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaagaggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuaugccauaauuggaccuggacugcaagcaaaagcuacuagagaagcucaaaaaaggacagcggccggaauaaugaaaaauccaaccguugauggaauuguugcaauagauuuggauccugugguuuaugauacaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauuuacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggacacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6113 - RNA, 9879 nt, Artificial Sequence
  derived and/or modified CDS sequence (wt) from DENV-1__EU482814__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccgacgcgacaaacguuccgucgcacuggccccacacgugggauuugguuuggaaacaagaaccgaaacguggauguccucugaaggcgcuuggaaacagauacaaagaguggagacuugggcccugagacacccaggauucacggugauagcccuuuuccuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaacuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgaccucccaaaaaacaacauggcuuccagugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcaccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccgggcaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaccaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcucugggagggaucuccaggaaaauuuuggaacaccacgauagcgguuuccauggcaaacauuuucagaggaaguuaccuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6114 - RNA, 9879 nt, Artificial Sequence
  derived and/or modified CDS sequence (wt) from DENV-1__EU482815__SS-prME
ucugugaccaugcuccuuaugcugaugccugcagccuuggcguuccauuugacuacacgagggggagagccgcacaugauaguuagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugcguuacaaaacuggaaggaaagacaguucaauaugaaaacuugaaauauucaguaacagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacaguggucguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugaucugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuuuuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugugaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcacucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggacccggacaugaggagccaauuccaauggcgaccuauggauggaaccuaguaaaacugcacuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagccgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuugggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6115 - RNA, 9879 nt, Artificial Sequence
  derived and/or modified CDS sequence (wt) from DENV-1__EU482816__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugugucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaacgaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucaacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuucccccuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugagccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugauauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauauuauugcgccgggcugaagaaagucacagaagugaagggauauacgaaaggaggaccuggacaugaggagccaauuccaauggcgaccuauggauggaaccuaguaaaacugcacuccgggaaagacguauucuuuacaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugacaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6116 - RNA, 9879 nt, Artificial Sequence
  derived and/or modified CDS sequence (wt) from DENV-1__EU482821__SS-prME
ucugugaccaugcuccucaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcaacagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacccuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuauuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcaaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6117 - RNA, 9879 nt, Artificial Sequence
  derived and/or modified CDS sequence (wt) from DENV-1__EU482822__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcaauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccauccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggccgagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuauuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagggagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguuggagauguaguugggaucuuggcucaaggaaaaaaaaugauuaggccacaacccauggaacacaaauacucguggaaaagcuggggaaaagcuaaaaucauaggggcagaugugcagaacaccaccuucaucaucgacggcccaaacaccccagaaugcccugaugaucaaagagcauggaacauuugggaaguugaggacuauggauuuggaauuuucacgacaaauauaugguugaaaaugcgugacuccuacacccaagugugugaccaccggcuaaugucagcugccaucaaggacagcaaggcaguucaugcugacaugggguacuggauagaaagugaaaagaacgagaccuggaagcuagcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguaggaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaagagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucauccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaauuauggcuguuggaguagucagcauccuacuaaguucacuucucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaguauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcaguaaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuuugagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagccguguugacugguggagugacgcuguucuuccuaucaggaaggggccuagggaaaacaucuaucggcuuacucugcgugauggcuucaagcguacugcuauggauggccaguguggaaccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucucgccuugggaugcuauucacaggugaauccacugacgcugacagcggcgguauugaugcuaguggcucacuacgccauaauuggaccuggauugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccauuacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugacauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaaaagacguggaccuaggcgcuggaacuagacauguggcaguggaaccagaaguagccaaccuggauaucauuggccagaggauagagaacauaaaacaugagcacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagugcaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugaaaaaagagagggagcuucacaaacagggaaaaugugccacguguguuuacaacaugauggggaagcgagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaacauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaacugugauggaugucauauccagacgugaccaaagaggaaguggccaggucggaacuuauggcuugaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6118 - RNA, 9879 nt, Artificial Sequence
  derived and/or modified CDS sequence (wt) from DENV-1__EU482476__SS-prME
ucugugaccaugcuucuuaugcugaugcccacagccuuggcguuccaucugacuacacgagggggagagccgcauaugauaguuaccaagcaggaaagaggaaagucacuuuuguucaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugcuauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaauggcaugaaauucacagugguuguaggagauguaguugggaucuuggcucaaggaaaaaaaaugauuaggccacaaccuauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcacaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucuuuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccauuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuacagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggaucaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacaccugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucaaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaauccuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaacuagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcauuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcagaugcaaagaaaacauggaggaaugcuagugcgaaauccacuuucaagaaauucuacucaugaaauguauuggguuucauguggaacaggaaacaucgugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacauaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgaaaggguucucgacuggcuggaaaaauauggcgucgaaaggcugaaaagaauggcaaucagcggagaugacugcguggugaaaccaauugaugacagguucgcaacagcccuagcagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcaguugauguauuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6119 - RNA, 9879 nt, Artificial Sequence
  derived and/or modified CDS sequence (wt) from DENV-1__EU482477__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagagcuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuuggcuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuaucuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucagugauagucaccguccacacuggagaccagcaccaggugggaaaugaaagcacagaacacgggacaacugcaacuauaacaccucaagcuccuucaacggaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagagacuuggaacagacaagauuugcuugugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacaugcauugcaguuggccuaguaacauuauaccuaggagucaugguucaggcggauucaggauguguaauuaauuggaaaggcagagaacucaaauguggaaguggcauuuuugucaccaaugaaguucacacuuggacagagcaauacaaauuucaagcugacuccccaaagagacuaucagcugccaucgggaaggcaugggaggaggguguguguggaauacgaucagcaacucgucucgagaacaucauguggaagcaaauaucaaaugaacugaaccacaucuuacuugaaaaugacaugaaauucacaguggucguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuagcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuuaauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuagcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguauuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucucauagcagaaaacaaaaucuggggaaggaaaaguuggccccucaaugaaggaaucauggcuguuggaauagucagcauucuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuccaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccccuaccagagauugaaaacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaguugagcagaaaaacuuuugauacagaguaccaaaaaacaaaaaauaacgacugggacuacgucgucacaacagacaucucugaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaaggagcgucucaggugaucuaauauuagaaauagggaaacuuccacaacaccugacgcaaagggcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcaaaccaggcggcuauauuaaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccagcugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaauauugugucagcaguaaacaugacauccagaaugcugcuaaaucgauucacaauggcucacaggaaaccaacguaugaaagagacguggaccuaggcgccggaacaagacauguggcaguggaaccugagguagccaaccuagauaucauaggccagaggauagagaacauaaaacaugaacauaagucaacauggcauuaugaugaggacaauccauauaaaacaugggccuaccauggaucauaugaggucaagccaucaggaucagccucauccauggucaaugguguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucucucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucgaucuuuaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacagguggccauaaaccaagugagaagacuaauugggaaugagaauuaucuagauuacaugacaucaaugaagagauucaagaacgagagugauccugaaggggcacucugguga

SEQ ID NO: 6120 - RNA, 9879 nt, Artificial Sequence
  derived and/or modified CDS sequence (wt) from DENV-1__EU482478__SS-prME
ucugugaccaugcuccuuaugcugaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccucuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagacuugaucucauauggaggagguuggaggcuucaaggauccuggaacacaggagaagaagugcaggugauugcuguugaaccagggaaaaaccccaaaaacguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucuccaguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccucuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagauagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacaacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 6121 - RNA, 9879 nt, Artificial Sequence
  derived and/or modified CDS sequence (wt) from DENV-1__EU482479__SS-prME
ucugugaccaugcuccuuaugcugaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacguuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugauaugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaagaagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaauguccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugauguaccgcuagcugggccacuaauagcuggaggcaugcuaauagcauguuauguuauaucuggaagcucagccgaccuaucauuagagaaagcggcugaggucuccugggaagaggaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguggggguaggaguuuuccaagaaaacguguuccacacaauguggcaugucaccaggggagcuguacucauguaucaagggaagagauuggaaccgagcugggccagugucaaaaaagaccugaucucauacggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugauggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaguggcuucaagcguuuugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaaaagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcugaaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 6122 - RNA, 9879 nt, Artificial Sequence
  derived and/or modified CDS sequence (wt) from DENV-1__EU482480__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggcgucaacaugugcacccuuauagcgauggauuugggagaguuuugugaggacacaaugacuuacaagugcccucggaucacugaggcggaaccagaugacguugauuguuggugcaaugccacagacacaugggugaccuauggaacauguacccaaauuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcuggcaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaauugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaauagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaaaaaaaugauuaggccacaacccauggaauacaaauacucguggaaaaucuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacaggccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuucaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugaucaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagguccgaagccaaagagggacugaaaagaggagaaacaaccaaacaugcagugucgagaggaacagcuaaacugaggugguuuguggagaggaaucucgugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucaguggaguggaaggagaaggacuccacaaacuuggauacauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaguuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6123 - RNA, 9879 nt, Artificial Sequence
  derived and/or modified CDS sequence (wt) from DENV-1__EU482481__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguucuguucagcgguguuuccuggaccaugaaaauaggaauagggguucugcugacauggcuaggauuaaauucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcgugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaaccacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuugcacgcuaccacccuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcaucuuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggaggcuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccauugugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagcccuuaaacaacgacgaagaucacgcucacuggaccgaagcaaaaaugcuccuugauaauauaaacacaccagaagggauuaucccagcccucuuugagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauaucagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuugcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuauugcaauagauuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugcgacacccuuuugugugauauuggugaguccucuccaaacccaaccauagaagaaggaagaacguuacgcguccuaaaaaugguggaaccauggcucagagggaaccaauuuugcauaaaaauucugaaucccuacaugccaagugugguggaaacucuggaacaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaaguaagaagacuaauugggaaugagaauuaucuagauuacaugacaucaaugaagagauucaagaacgagggugaucccgaaggggcacucugguga

SEQ ID NO: 6124 - RNA, 9879 nt, Artificial Sequence
  derived and/or modified CDS sequence (wt) from DENV-1__EU482482__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaaccggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuauggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacugagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacaggccaggauauuucacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggagcagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucacucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauaguuagcaucuuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccacuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagaucugaagccaaagaaggauugaaaagaggagaaacaaccaaacaugcagugucgagaggaaccgcuaaacugaggugguuuguggagaggaaccuugugaaaccugaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccaagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6125 - RNA, 9879 nt, Artificial Sequence
  derived and/or modified CDS sequence (wt) from DENV-1__EU482485__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucucaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauuacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuauuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccucucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcuuaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuccagaaugaggccagaauuacugacaucauggaaccugaacaugcccuacuggcuaagucaaucuucaagcuaaccuaccaaaauaaggugguaaggguacagagaccaacaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaguugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6126 - RNA, 9879 nt, Artificial Sequence
  derived and/or modified CDS sequence (wt) from DENV-1__EU482486__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagucugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguuuauucaagcuagagaaagaaguggcugagacccagcauggaaccguuuuagugcagauuaaauacgaaggaacagaugcaccaugcaagauccccuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauccgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguagaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuauaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaacuuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucauccuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugacaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccuugguuguggaagagguggcuggucauacuauugcgcugggcugaagaaagucacagaagugaagggauacacaaaaggaggacccggacaugaagaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugucuaggcaagucauaugcacaaauguggcaacugauguacuuccacaggagagaccugagauuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgauagugaucccgaaggggcacucugguga

SEQ ID NO: 6127 - RNA, 9879 nt, Artificial Sequence
  derived and/or modified CDS sequence (wt) from DENV-1__EU482487__SS-prME
ucugugaccaugcuccuuaugcugaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacguuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaauguccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugcaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguggggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaggaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucagggaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugauggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguuuugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccaugcggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcugaaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 6128 - RNA, 9879 nt, Artificial Sequence
  derived and/or modified CDS sequence (wt) from DENV-1__EU482488__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagagcuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugccaaguucaagugugugacaaaacuggaaggaaagauaguucaauaugaaaacuugaaauauucaguaauagucaccguccacacaggagaccagcaccagguggggaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuaguacagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacauuuuacuugaaaaugacaugaaacucacagugguuguaggagauguugcuggaaucuuggcucaaggaaaaaaaaugauuaggccacaacccauggaauacaaauacucauggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuccaaucacaucaguugugggcuaccuugcuguccuugacauuuaucagaacaacguuuuccuugcacuaugcauggaagacaauggcaaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacugaguucacuccucaaaaaugaugugccgcuagcugggccacuaauagcuggaggcaugcuaauagcauguuauguuauaucuggaagcucagccgaucuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagauaucuccgaaaugggagcaaauuuccgggccgacagggugauagacccaagacggugucugaaaccgguaauacuaaaagaugguccagagcgugucauuuuagcaggaccgaugccagugacuguagccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguucaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccggcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugagguuaagccgucagggucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguugggaagauguuccauauuugggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6129 - RNA, 9879 nt, Artificial Sequence
  derived and/or modified CDS sequence (wt) from DENV-1__EU482489__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacguugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaaguuacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuauuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucacuaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaguggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6130 - RNA, 9879 nt, Artificial Sequence
  derived and/or modified CDS sequence (wt) from DENV-1__EU482490__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuauaaaugcccucgaaucacugaaacugaaccagaugacguugauuguugguguaaugccacagacacaugggugaccuauggaacauguucccaaacuggcgagcaccggcgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacagaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucacaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaauuauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacuacuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaagauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggacuuacauccaggaucggggaaaacaagaagauaucuuccagccauaguccgugaggccauaaaaaggaagcugcgcacacuaauucuggcucccacgaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauaugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuugaacacuuucaccaacauggaagcccagcugauaagacaaauggagucugagggaaucuucucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6131 - RNA, 9879 nt, Artificial Sequence
  derived and/or modified CDS sequence (wt) from DENV-1__EU482491__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggcgucaacaugugcacccuuauagcgauggauuugggagaguuuugugaggacacaaugacuuacaagugcccucggaucacugaggcggaaccagaugacguugauuguuggugcaaugccacagacacaugggugaccuauggaacauguacccaaauuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcuggcaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaauugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaauagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaagagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaaaaaaaugauuaggccacaacccauggaauacaaauacucguggaaaaucuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacaggccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaagggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuacuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuucaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugaucaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacacugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagguccgaagccaaagagggacugaaaagaggagaaacaaccaaacaugcagugucgagaggaacagcuaaacugaggugguuuguggagaggaaucucgugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauacauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaguuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6132 - RNA, 9879 nt, Artificial Sequence
  derived and/or modified CDS sequence (wt) from DENV-1__EU482493__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauagugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaguuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgaguugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagauaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaagaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaguauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6133 - RNA, 9879 nt, Artificial Sequence
  derived and/or modified CDS sequence (wt) from DENV-1__EU482494__SS-prME
ucugugaccaugcuccuuaugcugaugccuacagccuuggcguuccaucugacuacacgagggggagagccgcacaugauagucagcaagcaggaaagaggaaagucacucuuguuuaagaccucagcagguguuaacaugugcacccuuauagcgauggauuugggagaguuaugugaggacacaauaacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcuggcaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccccaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucugguacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacggcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguagaaacucuggagcaaaugcaaagaaaacaugggggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6134 - RNA, 9879 nt, Artificial Sequence
  derived and/or modified CDS sequence (wt) from DENV-1__EU482495__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagucugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguuuauucaagcuagagaaagaaguggcugagacccagcauggaaccguuuuagugcagauuaaauacgaaggaacagaugcaccaugcaagauccccuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauccgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggagcuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguagaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccggggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuauaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugacaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacauagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccuugguuguggaagagguggcuggucauacuauugcgcugggcugaagaaagucacagaagugaagggauacacaaaaggaggacccggacaugaagaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacuuagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugucuaggcaagucauaugcacaaauguggcaacugauguacuuccacaggagagaccugagauuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgauagugaucccgaaggggcacucugguga

SEQ ID NO: 6135 - RNA, 9879 nt, Artificial Sequence
  derived and/or modified CDS sequence (wt) from DENV-1__EU482496__SS-prME
ucugugaccaugcuccuuaugcugaugccuacagccuuggcguuccauuugacuacacgagggggggagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcuaguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauuuaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaaucguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaauggcaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacauuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacuaagcaagucagaauuuaacaccuauaaaaggagugggaucauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccgaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacaugggggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaucuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagaucccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcugaaaaaauauggcgucgaaaggcugaaaagaauggcaaucagcggagaugacugcguagugaaaccaauugaugauagguuugcaacagccuugacagcucugaaugauaugggaaaagugagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6136 - RNA, 9879 nt, Artificial Sequence
  derived and/or modified CDS sequence (wt) from DENV-1__EU482497__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagggacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacauuauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuucuugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacacggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaccauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6137 - RNA, 9879 nt, Artificial Sequence
  derived and/or modified CDS sequence (wt) from DENV-1__EU482499__SS-prME
ucugugaccaugcuccuuaugcugaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacguuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaauguccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaggaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugauggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguuuugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccgagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcugaaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguugggaagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 6138 - RNA, 9879 nt, Artificial Sequence
  derived and/or modified CDS sequence (wt) from DENV-1__EU482500__SS-prME
ucugugaccaugcuccuuaugcugaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagacuugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccucuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaaaaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagauagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacaacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaaugcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaagccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugacuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 6139 - RNA, 9879 nt, Artificial Sequence
  derived and/or modified CDS sequence (wt) from DENV-1__EU482501__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuuguuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggcuauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagacgggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcucuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuugucccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaacauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcgugcugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggcugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucaccuagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauacuuaggaaaaagggaagaccaaugguguggaucccugauaggcuuaacagcaagggccaccugggccaccaauauacaaguggccauaaaccaagugagaagacuaauugggaaugagaauuaucuagauuacaugacaucaaugaagagauucaagaacgagagugaucccgaaggggcacucugguga

SEQ ID NO: 6140 - RNA, 9879 nt, Artificial Sequence
  derived and/or modified CDS sequence (wt) from DENV-1__EU482504__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuuuggaaaagggagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccucucgaugacgugcauugcaguuggccuaguaacacuauaccuaggagucaugguucaggcggauucaggauguguaauaaauuggaaagguagagaacucaaauguggaaguggcauuuucgucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaucggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggucaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaagcgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauaucagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccauuauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggcuggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucacaaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccauaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcaucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucaauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6141 - RNA, 9879 nt, Artificial Sequence
  derived and/or modified CDS sequence (wt) from DENV-1__EU482505__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuuaggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaagcauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcuaacucuaaaagggaugucauauguaaugugcacaggcucauucaagcuagagaaagaaguggcugagacccagcauggaaccguucuagugcagauuaaauaugaaggaacagaugcaccaugcaagauaccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaucagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggaugugugauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaacacaaauacucauggaaaagcuggggaaaggcuaaaaucauaggggcagaugugcagaaugccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcauuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccugaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcccccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuucugucucccgugagaguucccaauuacaacaugauuaucauggaugaagcacauuucaccgauccauccagcauagcggccagaggguacaucucaacccgaguggguaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucagggaggggccuagggaaaacaucuaucggccuacucugugugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugauacaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcggucuccauggcaaacauuuuuagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuucugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucaacagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagauugauccugaaggggcacucugguga

SEQ ID NO: 6142 - RNA, 9879 nt, Artificial Sequence
  derived and/or modified CDS sequence (wt) from DENV-1__EU482506__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagauacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggauucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaauaaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauacuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuaugucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugacaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaauuauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaagacugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 6143 - RNA, 9879 nt, Artificial Sequence
  derived and/or modified CDS sequence (wt) from DENV-1__EU482509__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucaucuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucugcuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugauaugggguacuggauagaaagugaaaagaacgagaccuggaagcuggcaagagccucuuucauagaaguuaaaacauguaucuggccaaaaucccacacucuauggagcaauggaguucuggaaagugaaaugauaguuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaauaaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccggggaaaaaccccaaaaauguacaaacagcgccgggcacuuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcgggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaggcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcugcgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggucagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggccuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaucagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaacccgaaggggcacucugguga

SEQ ID NO: 6144 - RNA, 9879 nt, Artificial Sequence
  derived and/or modified CDS sequence (wt) from DENV-1__EU482510__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcaggugucaacaugugcacccucauagcgauggauuuaggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagaccugggcccugagacacccaggauucacggugauagcccuuuuucuagcacaugcuauaggaacauccaucacccagaaagggauuauuuucauucuguuaaugcuagugacaccuuccauggccaugcgaugcgugggaauaggcagcagggacuucguggaaggacugucaggagcaacuuggguagaugugguacuggaacauggaagcugcgucaccaccauggcaaaagacaaaccaacauuggacauugaacucuugaggacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguucuagugcagauuaaauacgaaggaacagaugcaccaugcaagauccccuuuucgacccaagauggaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucacuuucgaugacgugcauugcaguuggucuaguaacacuauaccuaggagucaugguucaggcggauucaggauguguaauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaucacaucuuacuugaaaaugacaugaaauucacaguaguuguaggagauguuguugggaucuuggcucagggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaaguuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucauggucggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcauguuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagguguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccgguacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacauuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugaucaucauggaugaagcacauuucaccgauccauccagcauagcggccagaggauacaucucaacucgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaagcgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacgguguuugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagccuuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcguuucaggugauuuaauauuagaaauagggaaacucccacaacacuugacgcaaagggcccagaaugccuuggacaaccuggucauguugcacaacuccgaacaaggaggaagagccuauagacaugcaauggaagaacucccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauagccaguguggagccccauuggauagcggccuccaucauacuggaguucuucuugauggugcugcuuauuccagagccagacagacaacgcacaccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaauugagcaagucagaauuuaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaauauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacgaggcacugcacaaaucauggaggugacagccagaugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugagcgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucaguagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaauauggcgucgaaaggcuaaaaagaauggcaaucagcggagaugacugcguggugaaaccaauugaugacagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 6145 - RNA, 9879 nt, Artificial Sequence
  derived and/or modified CDS sequence (wt) from DENV-1__EU482511__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaauccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuauggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacugagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaaugucucagcacaacuacaggccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggagcagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucacucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcaucuuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccugaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggauguuaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccaagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccauuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6146 - RNA, 9879 nt, Artificial Sequence
  derived and/or modified CDS sequence (wt) from DENV-1__EU482513__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggcuacuggaccucugaccacgcuuugggagggaucuccaggaaaauuuuggaacaccacgauagcgguuuccauggcaaacauuuucagagggagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6147 - RNA, 9879 nt, Artificial Sequence
  derived and/or modified CDS sequence (wt) from DENV-1__EU482515__SS-prME
ucugugaccacgcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaauccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuauggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacugagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaaugucucagcacaacuacaggccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggagcaaaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucacucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcaucuuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccugaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggauguuaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccaagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggcuaccaacauacaaguggccauaaaccaagugagaagacuaauugggaaugagaauuaucuagauuacaugacaucaaugaagagauucaagaacgagagugaucccgaaggggcacucugguga

SEQ ID NO: 6148 - RNA, 9879 nt, Artificial Sequence
  derived and/or modified CDS sequence (wt) from DENV-1__EU482516__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugaucaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguagcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuguccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccucuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagguaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuaucggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuauuacucccaugaugaggcacacaaucgaaaacacaacggcaaacauuucccugacagccauugcaaaccaggcagcuauauugaugggacuugacaaaggauggccaauaucgaagauggacauaggaguuccacuccucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuauugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccagcuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6149 - RNA, 9879 nt, Artificial Sequence
  derived and/or modified CDS sequence (wt) from DENV-1__EU482517__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaacacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucagcggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaauccuuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggacucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6150 - RNA, 9879 nt, Artificial Sequence
  derived and/or modified CDS sequence (wt) from DENV-1__EU482519__SS-prME
ucugugaccaugcuacuuaugcugaugcccacagccuuggcguuccaccugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauggcccuuuuucuagcacaugccauaggaacguccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagguaguucaauaugaaaacuugaaauauucaguaauagucaccguccacacuggagaccagcaccaggugggaaaugaaagcacagaacacgggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacacaaccuucaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccggcuaaugucagcugccaucaaggacagcaaggcaguucaugcugacaugggguacuggauagaaagugaaaagaacgagaccuggaagcuggcaagagccucuuucauagaaguuaaaacaugcaucuggccaaaaucccacacucuauggagcaauggaguucuggaaagugaaaugguaauuccaaaaaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaccagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugaucuuaaaauuauugacugacuuucagucgcaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccuuaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguucaagaugauggaacuaugaagauaaaggaugaagagagagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagacuccugaaggugaaguuggagccauugcccuagauuuuaaacccggcacaucuggaucucccauugugaacagagaaggaaaaauaguaggucuuuauggaaauggaguggugacaacaaguggaaccuacgucagugccauagcucaagccaaagcaucacaagaagguccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguuacacaacuccgaacaaggaggaagagccuauagacaugcaauggaagaacugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacacuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcagaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccauaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6151 - RNA, 9879 nt, Artificial Sequence
  derived and/or modified CDS sequence (wt) from DENV-1__EU482520__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugagagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggauggacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaauacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcgaacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcaaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6152 - RNA, 9879 nt, Artificial Sequence
  derived and/or modified CDS sequence (wt) from DENV-1__EU482521__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaagcugaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugaggcacccaggauucacggugauagcccucuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagcuuaauaacgugugcuaaguucaagugugugacaaaacuggaaggaaagauaguucaauaugaaaacuugaaauauucaguaauaguuaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacguuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggagaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacguccuuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggagaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccauacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaagaugcugaugacuggaacacuggcuguguuccuccuucucauaaugggacaauugacauggaaugaucugaucagacuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuccuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauucaucaaaacaacguuuuccuugcacuaugcauggaagacaauggcuauggugcugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacauuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugccuuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaaaggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccuacgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaauaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuguaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagauuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6153 - RNA, 9879 nt, Artificial Sequence
  derived and/or modified CDS sequence (wt) from DENV-1__EU482523__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauacaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6154 - RNA, 9879 nt, Artificial Sequence
  derived and/or modified CDS sequence (wt) from DENV-1__EU482525__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucacuguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacguccuuuucgaugacgugcauugcagucggccuaguaacgcuauacuuaggagucaugguucaggcagauucaggauguguaauuaacuggaaagguagagaacucaaauguggaaguggcauuuuugucaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguuuuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcggcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcaucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagacugaucccgaaggggcacucugguga

SEQ ID NO: 6155 - RNA, 9879 nt, Artificial Sequence
  derived and/or modified CDS sequence (wt) from DENV-1__EU482526__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggauacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuucaaugaaaugguguuguugacaaugaaagaaaaaucauggcuaguccacaaacaaugguuucuagaccuaccacugcccuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguuccauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaucggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguagaugaacauuguggaaaucgaggaccaucucuuagaaccacaacagucacaggaaagauaauucaugaaugguguugcagaucuugcacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucucacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuaucaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagccguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcaccgggcaccuucaagaccccugaaggugaaguuggagccauugcccuagauuuuaaacccggcacaucuggaucucccauagugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcuccuacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaggcagcugcgaucuucaugacagccacucccccaggaucaguggaggccuuuccacagagcaaugcaguuauccaagaugaggaaagagacaucccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccaaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuccgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacacuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgcgaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuuggauucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuucacccagcgaauuggagaucccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggcaaccugggccucuaacauacaaguggccauaaaccaagugagaagacuaauugggaaugagaauuaucuagauuacaugacaucaaugaagagauucaagaacgagggugaucccgaaggggcacucugguga

SEQ ID NO: 6156 - RNA, 9879 nt, Artificial Sequence
  derived and/or modified CDS sequence (wt) from DENV-1__EU482527__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaaccgcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagauggaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggauuauggauuuggaauuuucacgacaaacauauggcugaaauugcgugauuccuacacccaagugugugaccaccggcuaaugucagcugccaucaaggacagcaaggcaguucacgccgacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcauuuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaggggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcccacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggucagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaagguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgagcaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 6157 - RNA, 9879 nt, Artificial Sequence
  derived and/or modified CDS sequence (wt) from DENV-1__EU482528__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccgacgcgacaaacguuccgucgcacuggccccacacgugggacuugguuuggaaacaagaacugagacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagccaugguucaggcggauucgggauguguaauuaauuggaaagguagagaacucaaauguggaaguggcauuuuugucaccaaugaaguucacacuuggacagagcaauacaaauuucaagcugacuccccaaagagauuaucagcagccaucgggaaggcaugggaggaggguguguguggaauacgaucagcaacucgucucgagaacaucauguggaagcaaauaucaaaugaacugaaccacaucuuacuugaaaaugauaugaaauucacagugguuguaggagauguugcuggaaucuuggcucaaggaaaaaaaaugauuaggccacaacccauggaauacaaacacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguuuuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucuggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucuguuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuauucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauacacgaaaggaggaccuggacaugaggagccaauuccaauggcgacuuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccggggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggaggggaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6158 - RNA, 9879 nt, Artificial Sequence
  derived and/or modified CDS sequence (wt) from DENV-1__EU482529__SS-prME
ucugugaccaugcuccuuaugcugaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacauuacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 6159 - RNA, 9879 nt, Artificial Sequence
  derived and/or modified CDS sequence (wt) from DENV-1__EU482531__SS-prME
ucugugaccaugcugcuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguuaacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacacaaccuucaucaucgacggcccaaacaccccagaaugcccuaaugaucaaagagcauggaacauuugggaaguugaggacuauggauuuggaauuuucacgacaaauauaugguugaaauugcgugacuccuacacucaagcgugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggagagugaaaugguaauuccaaaaaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuugcguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagcugacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaauagagaaggaaaaauaguaggucuuuauggaaauggaguggugacaacaaguggaaccuacgucagugccauagcucaagccaaagcaucacaagaagguccccuaccagagauugaagaugagguguuuaggaaaagaaacuuaacaauaauggaccuacauccaggaucggggaaaacaagaagauaucucccagccauaguccgugaggcuauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacacuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaauuuguacaagagaggaguucacaaggaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6160 - RNA, 9879 nt, Artificial Sequence
  derived and/or modified CDS sequence (wt) from DENV-1__EU482532__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauucaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggagggcguguguggaauacgaucaacaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaucaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacaaagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcugcugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccuugguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaauccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgauucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6161 - RNA, 9879 nt, Artificial Sequence
  derived and/or modified CDS sequence (wt) from DENV-1__EU482533__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuccuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguaaucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaaugccaccuucaucaucgacggcccaaacaccccagaaugcccugacgaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcucucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuccucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggcauucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugacaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacucacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 6162 - RNA, 9879 nt, Artificial Sequence
  derived and/or modified CDS sequence (wt) from DENV-1__EU482534__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauaguuacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaaaaaaaugauuaggccacaacccauggaguacaaauacucguggaaaagcuggggaaaagcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccuugacauuugucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugacgugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugaucgcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuuuaccgauccauccagcauagcggccagaggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaccuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagagacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6163 - RNA, 9879 nt, Artificial Sequence
  derived and/or modified CDS sequence (wt) from DENV-1__EU482535__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcaauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggccgagacccagcauggaaccguuuuagugcagauuaaauacgaaggaacagaugcaccaugcaagaucccuuucucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuauuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagggagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaaguuggggaaaagcuaaaaucauaggggcagaugugcagaacaccaccuucaucaucgacggcccaaacaccccagaaugcccugaugaucaaagagcauggaacauuugggaaguugaggacuauggauuuggaauuuucacgacaaauauaugguugaaaaugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacacuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguaggaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaagagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucauccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaauuauggcuguuggaguagucagcauccuacuaaguucacuucucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaagaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugaaguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauagacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagccguguugacugguggagugacgcuguucuuccuaucaggaaggggccuagggaaaacaucuaucggcuuacucugcgugauggcuucaagcguacugcuauggauggccaguguggaaccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccaugcggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucucgccuugggaugcuauucacaggugaauccacugacgcugacagcggcgguauugaugcuaguggcucacuacgccauaauuggaccuggauugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccauuacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugacauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaaaagacguggaccuaggcgcuggaacuagacauguggcaguggaaccagaaguagccaaccuggauaucauuggccagaggauagagaacauaaaacaugagcacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagugcaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugaaaaaagagagggagcuucacaaacagggaaaaugugccacguguguuuacaacaugauggggaagcgagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaacauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaacugugauggaugucauauccagacgugaccaaagaggaaguggccaggucggaacuuauggcuugaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguuaauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6164 - RNA, 9879 nt, Artificial Sequence
  derived and/or modified CDS sequence (wt) from DENV-1__EU482536__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggaaacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaauaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuagguuuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacaugcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagaggcuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugagggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccuuuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggcuuucucauuaaugaaaucucuaggaggagguagaagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugagguuaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugcuacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6165 - RNA, 9879 nt, Artificial Sequence
  derived and/or modified CDS sequence (wt) from DENV-1__EU482537__SS-prME
ucugugaccaugcugcuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucugaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacacaaccuucaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggagagugaaaugguaauuccaaaaaucuauggaggaccaauaucucagcacaacuacagaccaggauauuucacacaaacggcagggccguggcaucuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagcugacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagagggcuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaauagagaaggaaaaauaguaggucuuuauggaaauggaguggugacaacaaguggaaccuacgucagugccauagcucaagccaaagcaucacaagaagguccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacgguguuugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagcuaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacacuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaauuuguacaagagaggaguucacaaggaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaaggaagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 6166 - RNA, 9879 nt, Artificial Sequence
  derived and/or modified CDS sequence (wt) from DENV-1__EU482538__SS-prME
ucugugaccaugcuccuuaugcugaugccuacagccuuggcguuccauuugacuacacgagggggagagccgcacaugauagucagcaagcaggaaagaggaaagucacuuuuguuuaagaccuccgcaggugucaacaugugcacccuuauagcgauggauuugggagaguuuugugaggacacaaugacuuacaagugcccucgaaucacugaggcggaaccagaugacguugauugcuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggaaacuugggcccugagacacccaggauucacggugauagcccuuuuucuagcacaugccauaggaacauccaucacccagaaagggauuauuuucauucuguuaaugcugguaacaccauccauggcaaugcgaugugugggaauagguagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacagagaaaaaccagucaacauugaggcagaaccgccuuuuggugagaguuacauugugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaauacccuagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaaaccaaagcaucacaagaagggccucuaccagagauugaagacgagguguuuaggaaaagaaacuuaacaauaauggaccuacauccaggaucagggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguucguggauaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugcuacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcuacagccuuaacugcucugaaugauaugggaaaaguuagaaaagauauaccacaaugggaaccuucaaaaggauggaaugauuggcaacaagugccuuuuugcucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguugggaagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 6167 - RNA, 9879 nt, Artificial Sequence
  derived and/or modified CDS sequence (wt) from DENV-1__EU482539__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacauuacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcaaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuccacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6168 - RNA, 9879 nt, Artificial Sequence
  derived and/or modified CDS sequence (wt) from DENV-1__KP188539__SS-prME
uccgugaccaugcuccucaugcugcugcccacagcccuggccuuccauuugacuacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugauguugacugcuggugcaaugccacagacacaugggugaccuaugggacguguucucaaaccggcgaacaccgacgagacaaacguuccgucgcacuggccccacacgugggacuuggucuagaaacaagaacugaaacguggaugucaucugaaggcgccuggaaacaaauacaaaaaguggagacuugggcuuugcgacacccaggauucacggugauagcccuuuucuuggcacaugccauaggaacauccaucacccagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagccaaaauaucaaacaccaccaccgauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaucauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauacgugaugugcacaggcucauuuaagcuagagaaggaaguggcugagacccagcauggaacuguuuuagugcagguuaaauacgaaggaacagaugcaccaugcaagaucccuuuuuugacccaagaugagaaaggagugacccagaaugggagauugauaacagccaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacacugcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacgcuguaccuaggagucaugguucaagcggacucgggaugugugaucaacuggaagggcagagaacucaaauguggaaguggcaucuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacguuaauggaauuuuggcccaagggaaaaaaaugauuagaccacaacccauggaacacaaauacucauggaaaaguuggggaaaagcuaagaucauaggagcagacauacagaacaccaccuuuaucauugacggcccagacacuccagaaugucccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauauggguuacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgaggcccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaauggacaguuuuucauuaggaauacuaugcguaucaauacugauugaagaaguaaugagauccagauggaguagaaagaugcugaugacuggaacacuggcuguuuuccuccuucucauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacauccagagaaguucuucuucucacgguuggauuaagccugguugcauccguggagcuaccaaauucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaagaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugauacacucaccauacuccucaaagcaacucugcuggcggucucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguguuccauacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaaaauaguaggucuuuauggaaauggaguggugacaacaaguggaaccuacgucagugccaucgcucaagcuaaagcaacacaagaagggccucuaccagagauugaggacgagguguuuaagaaaagaaacuuaacaauaauggaccugcacccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacacuuuacugauccagccagcauagcagccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuaugacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaaggcccagagcgcguuauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagauggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaagugaccuaauauuggaaauaggaaaacuuccacaacauuugacgcuaagagcccagaaugcucuggacaacuuggucauguugcacaauuccgaacaaggaggaaaagccuacagacaugccauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccacauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugauaagggauggccaauaucgaagauggauauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagaggugguuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggcgaguccucuccaaauccaacuauagaagaaggaagaacauuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacacaagucaacauggcauuaugaugaagacaauccauacaaaacaugggccuaucauggaucauaugaggucaaaccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaaucauggaggugacagccaagugguuaugggguuuccuauccagaaccaaaaaacccagaaucugcacaagagaggaguucacaagaaaaguuaggucaaacgcagcaauaggagcaguguuuguugaugaaaaccaauggaacucagcaaaagaagcuguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagaaaguucuugacuggcuggaaaaacauggcgcugaaaggcugaaaagaauggcaauuagcggagaugauugcguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaucagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaacauacaaguagccauaaaccaagugagaaggcucaucgggaaugagaauuaucuagauuauaugacaucaaugaagagauucaagaaugagagugaucccgaaggggcacucugguaa

SEQ ID NO: 6169 - RNA, 9879 nt, Artificial Sequence
  derived and/or modified CDS sequence (wt) from DENV-1__KP188540__SS-prME
uccgugaccaugcuccucaugcugcugcccacagcccuggcguuucauuugaccacacgagggggagagccacacaugauaguuaguaagcaagaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguuuaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacgaugaaagaaaaaucauggcuuguccacaaacaaugguuucuagacuuaccacugccauggacuucgggggcuucaacaucucaagagaccuggaacagacaagauuugcuggucacauucaagacagcucacgcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaagggaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaagcuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaaugcuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguucaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuaugucagugccauugcccaagcuaaagcaucacaggaagggccucuaccagagauugagaacgagguguucaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggauacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcguguuauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagccaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggauguggagaucuggacaaaggaaggagaaagaaagaaauugcgaccucgcugguuggacgccagaacauacucugauccauuggcccugcgcgaguucaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacacuauagaaacauugaugcuucuagcuuugauagcuguguugacugguggagcgacgcuauucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucucaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacucaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaagucgacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguggccauaaaccaagugagaaggcucaucgggaaugagaauuauuuagauuacaugacaucaaugaagagauucaagaaugagagugaucccgaaggagcacucugguaa

SEQ ID NO: 6170 - RNA, 9879 nt, Artificial Sequence
  derived and/or modified CDS sequence (wt) from DENV-1__KP188541__SS-prME
uccgugaccaugcuccucaugcugcugcccacagcccuggcguuucauuugaccacacgagggggagagccacacaugauaguuaguaagcaagaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcuuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcuggggcaauggcuguggacuauucggaaagggaagucuauugacgugugccaaguuuaagugugugacaaaauuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacacuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaagauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaagggaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaagcuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauugagccugguggcauccguggagcuaccaaauucucuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuuuuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagccuguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagaggggaaaauagugggucuguauggaaauggaguggugacaacaaguggaaccuaugucagugccauugcccaagcuaaagcaucacaggaagggccucuaccagagauugagaacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuucaccgauccagcuagcauagcggcuagaggauacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcgaauuuccgggccgacaggguaauagacccaaggcggugcuugaaaccgguaauacuaaaagaugguccagagcguguuauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagccaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguucaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuguggaggaacuaccagacaccauagaaacauugaugcuucuagcuuugauagcuguguugacugguggagugacgcuauucuuccuaucaggaaaaggucuagggaaaacauccauuggcuugcucugugugacggccucaagcgcacuguuauggauggccaguguggagccccauuggauagcggccuccaucauacuggaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucucaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauauacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaaugcuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaagucgacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaacuuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguggccauaaaucaagugagaaggcucaucgggaaugagaauuauuuagauuacaugacaucaaugaagagauucaagaaugagagugaucccgaaggagcacucugguaa

SEQ ID NO: 6171 - RNA, 9879 nt, Artificial Sequence
  derived and/or modified CDS sequence (wt) from DENV-1__KP188543__SS-prME
uccgugaccaugcuccucaugcugcugcccacagcccuggccuuucauuugacuacacgagggggagagccacauaugauagucagcaagcaggaaagaggaaagucacucuuguuuaagaccucuguaggugucaacaugugcacucucauugcgauggauuugggagaguuaugugaggacacaaugaccuauaaaugcccccggaucacugagguggaaccagaugauguugacugcuggugcaaugccacagacacaugggugaccuaugggacguguucucaaaccggcgaacaccgacgagacaaacguuccgucgcacuggccccacacgugggacuugguuuagaaacaagaacugaaacguggaugucaucugaaggcgccuggaaacaaauacaaaaaguggagacuugggcuuugcgacacccaggauucacggugauagcccuuuucuuggcacaugccauaggaacauccaucacccagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugcgugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucaggagcuucaacaucccaagagacuuggaacagacaagauuugcuggucacauucaagacagcucaugcaaagaaacaggaaguagucgugcugggaucacaggaaggagcaaugcacaccgcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuagagaaggaaguggcugagacccagcauggaaccguuuuagugcagguuaaauacgaaggaacagaugcaccaugcaagaucccuuuuuugacccaagaugagaaaggagugacccagaaugggagauugauaacagcuaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacacugcaugggacuucggcucuauaggaggauuguucacguccgugggaaaauugauacaccagguuuuuggaacugcauaugggguucuguucagcggugucucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcaucuuugucacuaaugaaguccacacuuggacagagcaauauaaauuccaggcugacuccccaaaaagacugucagcagccauuggaaaggcaugggaggaaggcguguguggaauucgaucagccacgcgucuugagaacaucauguggaagcaaauaucaaaugaauugaacuacauccuacuugaaaaugacaugaaauucacagugguuguaggagacgucaauggaauuuuggcccaaggaaaaaaaaugauuagaccacaacccauggaacacaaauacucauggaaaaguuggggaaaagccaagaucauaggagcagacauacagaacaccaccuuuaucauugacggcccagauacuccagaaugccccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauaugggguacuggauagaaagugaaaagaacgagaccuggaagcuagcgagagccucuuuuauagaagucaagacaugcaucuggccgaaaucccacacucuauggaguaauggaguuuuggaaagugaaaugguaaucccaaagauauauggaggaccaauaucucagcauaacuacagaccaggguauuucacacaaacagcagggccauggcaccuaggcaaguuggaauuggauuuugacuugugugaagguaccacaguuguuguagaugaacauuguggauaucgaggcccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaauggacaguuuuucauuaggaauacuaugcguaucaauacugauugaagaaguaaugagauccagauggaguagaaagaugcugaugacuggaacacuggcuguuuuccuccuucucauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacauccagagaaguucuucuucucacgguuggacuaagccugguggcauccguagagcuaccaaauucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggccauggcacugucaaucguaucucucuuuccuuugugucugucuacgaccucccaaaaaacaacauggcuuccggugcuguuaggaucuuuuggauguaaaccauuaaccauguuucucauaacggaaaacaaaauuuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauaucuggaaguucagcugauuuaucauuggaaaaagcggcugagguauccugggaagaagaagcagaacacuccggcaccucacacaacauauuaguggagguccaagaugauggaaccaugaaaauaaaagaugaagagagggaugauacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguauuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacauccggaucucccaucgugaacagagagggaaaaauaguaggucuuuauggaaauggaguggugacaacaaguggaaccuacgucagugccaucgcucaagcuaaagcaacacaagaagggccucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaacuacaacaugauuaucauggaugaagcacacuuuacugauccagccagcauagcagccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcauuaaaucaggaaaugacauagcuaacuguuuaagaaagaacggaaaacgggugauucaacugagcaggaaaaccuuugacacugaguaccagaaaacaaaaaacaaugacugggacuacguugucacaacagacaucuccgaaaugggagcaaauuuccgggccgacaggguaauagauccaaggcggugcuugaaaccgguaauacuaaaggaagguccagagcgcguuauccuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgauagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguucgcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacacuguucuuccuaucaggaaaaggucuagggaaaacauccauuggccuacuuugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugauaagggauggccaauaucgaagauggauauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucguagaccucgguugugggagaggugguuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacauaagucaacauggcauuaugaugaagacaauccauacaaaacaugggccuaucauggaucauaugaggucaaaccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauugggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuucucacccagcgaacuggaaacccccaaucuagcuaagaaaguucuugacuggcuggaaaaacauggcgcugaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaucagcugaucaugaaagauggaagagaaauaguggugccaugccgcaaccaagaugaacuugugggcagggcuagagugucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaaaacaaaacucauguauccaguugggaagaaguuccauaccuagggaaaagggaagaucaaugguguggauccuugauagguuugacagcaagggccaccugggccacuaauauacaaguagccauaaaccaagugagaaggcucaucgggaaugagaauuaucuagauuauaugacaucaaugaagagauucaagaaugagagugaucccgaaggggcacucugguaa

SEQ ID NO: 6172 - RNA, 9879 nt, Artificial Sequence
  derived and/or modified CDS sequence (wt) from DENV-1__KP188544__SS-prME
uccgugaccaugcuccucaugcugcugcccacagcccuggccuuccauuugacuacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugauguugacugcuggugcaaugccacagacacaugggugaccuaugggacgugcucucaaaccggcgaacaccgacgagacaaacguuccgucgcacuggccccacacgugggacuuggucuagaaacaagaacugaaacguggaugucaucugaaggcgccuggaaacaaauacaaaaaguggagacuugggcuuugcgacacccaggauucacggugauagcccuuuucuuggcacaugccauaggaacauccaucacccagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagaucccuuuuuugacccaagaugagaaaggagugacccagaaugggagauugauaacagcuaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacacugcaugggacuucgguucuauaggaggauuguucacgucugugggaaaauugauacaccagguuuuugggacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcaucuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacguuaauggaauuuuggcccaagggaaaaaaaugauuagaccacaacccauggaacacaaauacucauggaaaaguuggggaaaagccaagaucauaggagcagacauacagaacaccaccuuuaucauugacggcccagauacuccagaaugccccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucucagcacaacuacagaccaggguauuucacacaaacagcagggccauggcaccuaggcaaguuggaacuggauuuugacuugugugaagguaccacaguuguuguagaugaacauuguggauaucgaggcccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauauugauugaagaaguaaugagauccagauggaguagaaagaugcugaugacuggaacacuggcuguuuuccuccuucucauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacaugcagagaaguucuucuucucacggucggauuaagccugguggcauccguggagcuaccaaauucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugauacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccggaaguggagagggcaguucuugaugauggcauuuauagaaucuugcaaagaggacuguuggguaggucccaaguaggagugggaguuuuccaagacggcguguuccacacaauguggcacgucaccaggggagcuguccuuaugcaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaaaauaguaggucuuuauggaaauggaguggugacaacaaguggaaccuacgucagugccaucgcucaagcuaaagcaacacaagaagggccucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacacuuuacugauccagccagcauagcagccagaggguacaucucaacccgagugggcaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuugagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaagguccagagcgcguuauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggcuuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuagggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugauaagggauggccaauaucgaagauggauauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaagucuuuaggaggagguaggagaggaacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagaggugguuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaacauaaaaaaugaacauaagucaacauggcaucaugaugaagacaauccauacaaaacaugggccuaucauggaucauaugaggucaaaccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagaaaguucuugacuggcuggaaaaacauggcgcugaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaucagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaauauacaaguagccauaaaccaagugagaaggcuuaucgggaaugagaauuaucuagauuauaugacaucaaugaagagauucaagaaugagagugaucccgaaggggcacucugguaa

SEQ ID NO: 6173 - RNA, 9879 nt, Artificial Sequence
  derived and/or modified CDS sequence (wt) from DENV-1__KP188547__SS-prME
uccgugaccaugcuccucaugcugcuacccacagcccuggccuuccauuugacuacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugauguugacugcuggugcaaugccacagacacaugggugaccuaugggacguguucucaaaccggcgaacaccgacgagacaaacguuccgucgcacuggccccacacgugggacuuggucuagaaacaagaacugaaacguggaugucaucugaaggcgccuggaaacaaauacaaaaaguggagacuugggcuuugcgacacccaggauucacggugauagcccuuuucuuggcacaugccauaggaacauccaucacccagaaagggaucauuuucaucuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccauccugcgcaaacugugcauugaagcuaaaauaucaaacaccaccaccgauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugugugacaaaacucgaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagacgcaccaugcaagaucccuuuucugacccaagaugaaaaaggagugacccagaaugggagauugauaacagcuaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacacugcaugggacuucggcucuauaggaggauuguucacgucugugggaaaauugauacaucagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcaucuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguugugggagacguuaauggaauuuuggcccaaggaaaaaaaaugauuaaaccacaacccauggaacacaaauacucauggaaaaguuggggaaaagccaagaucauaggagcagacauacagaacaccaccuuuaucauugacggcccagauacuccagaaugccccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgaggcccaucccucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauacugauugaagaagugaugagaucuagauggaguagaaagaugcugaugacuggaacacuggcuguuuuccuccuucucauaaugggacaacugacauggaaugaucugaucagguuaugcaucaugguuggagccaaugcuuuagacaggauggggauggggacaacguaccuagccuugauggccacuuucaaaaugagaccaauguucgcuguugggcuauuguuucgcagacuaacauccagagaaguucuucuucucacgguuggauuaagccugguggcauccguggagcuaccaagcucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugauacacucaccauacuccucaaagcaacucugcuugcagucucaggaguguacccaaugucaauaccggcaacucuuuuugugugguauuuuuggcagaaaaagaaacagagaucaggagugcuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccaucgcucaagcuaaagcaacacaagaagggacucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccgauaagauaccagacaacagcagugaagagugaacauacaggaagggagauaguugaccucaugugccaugccacuuuuaccaugcgucucuuaucuccagugagaguucccaauuacaacaugauuaucauggaugaagcacacuuuacugauccagccagcauagcagccagaggguacaucucaacccgaguggguaugggugaagcagcugcgauuuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaagguccagagcgcguuauucuagccggaccgaugccagugacuguggccagugccgcccagaggagaggaagaauuggaaggaaccaaaacaaagaaggugaucaguacauuuacaugggacagccuuugaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaacaaccagguguuggaggagaacauggacguggagaucuggacaaaggaaggagaaagaaagaaauugcgaccccgcuggcuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacguuguucuuccuaucaggaaaaggucuagggaaaacauccauuggccuacucugugugauggccucaagcgcacuguuauggauggccaguguggagccccauuggauagcggcuuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugauaagggauggccaauaucgaagauggauauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggccaaauaauguuacugauacuuuguacaucacagauucucuugaugcggaccacaugggccuugugugaauccaucacacuggccacuggacccuugacuacucuuugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagaggugguuggucauauuacugcgcuggacugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcuuagaggaaaccaauucugcauaaaaauucuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacauaagucaacauggcauuaugaugaagacaauccuuacaaaacaugggccuaucauggaucauaugaggucaaaccaucaggaucagccucauccauggugaauggcguggugagauugcucacuaaaccaugggaugucauccccauggucacacaaauagcuaugacugauaccacacccuuuggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaagucaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaacgaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagaaaguucuugacuggcuggaaaaacauggcgcugaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaucagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuaggaaaaagggaagaucaaugguguggauccuugauagguuugacagcaagggccaccugggccacuaauauacaaguagcuauaaaccaagugagaaggcucaucgggaaugagaauuaucuagacuauaugacaucaaugaagagauucaagaaugagagugaucccgaaggggcacucugguaa

SEQ ID NO: 6174 - RNA, 9879 nt, Artificial Sequence
  derived and/or modified CDS sequence (wt) from DENV-1__KP723473__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauuaccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguuuaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggcuacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuagauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaaguucagccgauuuaucauuggagagagcggcugaggucuccugggaagaagaagcagaacacucuggugccucacacaacauacuaguggagguccaagaugauggaaccaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagagggagaaagaaagaaaugcgacucgcgcugguuagaugccagaaccuacucugauccacuggcccugcgcgaguuuaaggaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaauccaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggacagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuccagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguguggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6175 - RNA, 9879 nt, Artificial Sequence
  derived and/or modified CDS sequence (wt) from DENV-1__KT187564__SS-prME
ucugugaccaugcuccuuaugcugaugcccacagccuuggcguuccauuugacuacacgagggggagagccgcacaugaugguuagcaagcaggaaagaggaaagucacuucuguuuaagaccucagcaggugucaacaugugcacccuuauagcgauggauuugggagaguuaugugaggacacaaugacuuacaaaugcccucgaaucacugaggcggaaccagaugauguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacauccaggauuuacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagauguggugcuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaauuuugugugucgacgaacguuuguggauagaggcuggggcaauggcugugggcucuucggaaaaggaagccuuauaacgugugcuaaguucaagugugugacaaaauuggaaggaaaaauaguucaauaugaaaacuugaaauauucaguaauugucaccguccacacuggagaccagcaccaagugggaaaugaaagcacagaacaugggacaacugcaacuauaacaccucaagcucccacgacggaaauacagcugaccgacuacggagcucuuacacuggauuguucaccuagaacaggacuagacuuuaaugaaaugguguuguugacaaugaaaggaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacauuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauuccuuuuucgacccaagaugaaaaaggaguaacucagaaugggagauuaauaacagccaaccccauaguuacugacaaagaaaagccagucaacauugaggcggaaccgccuuuuggugagaguuacauugugauaggagcaggugaaaaagcuuugaaacuaagcugguucaagaaaggaaguagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauaugggguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacucgaaaaugacaugaaauucacagugguuguaggagauguugcugggaucuuggcucaggggaaaaaaaugauuaggccacaacccauggaauacaaauacucguggaaaagcuggggaaaggcuaaaaucauaggggcagauguacagaacaccaccuucaucaucgacggcccaaacaccccagaaugcccugaugaucaaagagcguggaacauuugggaaguugaggauuauggauuuggaauuuucacgacaaacauauggcugaaauugcgugacuccuacacccaagugugugaccaccggcuuaugucagcugccaucaaggacagcaaggcaguucacgcugacaugggguacuggauagaaagugaaaagaacgagaccuggaagcuggcaagagccucuuucauagaagucaaaacauguauuuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgagggccaucucuuaggaccacaacagucacaggaaagauaauccaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacugggacugcuaugcauaucaauaaugaucgaagaggugaugagauccagauggaguagaaaaaugcugaugauuggaacauuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaaucggauugagucuaguggcaucugcggaguuaccaaauuccuuggaggagcugggggacggacuugcaaugggcauuaugauuuuaaaauuauugacugacuuucaaucacaucagcugugggcuacuuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuaugucauaucuggaaguucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguucccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggcccuuaccagagauugaagacgagguguuuaggaaaagaaacuuaacaauaauggaccuacauccaggaucggggaaaacaagaagauaccuuccagccauaguccgugaggccauaaaaaggaaacugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuucugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaaugacugggacuaugucgucacaacagacaucuccgaaaugggagcaaauuuccgggccgacagggugauagacccaagacggugucugaaaccgguaauacuaaaagaugguccagagcgcgucaucuuagcaggaccgaugccagugacuguggccagugcugcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggagaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggauguggagaucuggacaaaagaaggagaaagaaagaagcuacgaccccgcuggcuggaugccagaacauacucagacccacuggcuuugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacauccaucggccuacucugcgugauggcuucaagcguacugcuauggauggccaguguagagccccauuggauagcggccucuaucauacuggaguucuuccugauggugcugcuuauuccagagccagacagacaacgcacuccgcaggacaaccagcuggcauauguggugauagguuuguuauucaugauacugacaguagcagcuaaugagaugggacugcuggaaaccacaaagaaagacuuagggauuggccauguggcuguugaaaaccaccaccaugccgcaaugcuggacguggacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucaaagauggacauaggaguuccacuucucgccuuggggugcuauucccaggugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguugcugauacuaugcacaucacagauccucuugaugcggacuacaugggccuugugcgaauccaucacguuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacgacugaaccaacugagcaagucagaauuuaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauauuauugcgcugggcugaagaaagucacagaagugaagggauauacaaaaggaggaccuggacaugaagaaccaaucccaauggcgaccuauggauggaaccuaguaaagcugcauuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggagggaugcuagugcgaaauccacuuucaagaaauuccacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacacguggcaguggaaccagagguagccaaccuagauaucauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaggagaaaguugauacacgcacaccaaaagcaaaacgaggcacagcacaaaucauggaggugacagccaggugguuaugggguuuucuuucuaggaacaagaagccaagaauuuguacaagagaggaguucacaagaaaaguuaggucaaacgcagccaucggagcaguguucauugacgaaaaucaauggaacucagcaaaagaagcaguggaagaugagcgguucugggaccuugugcacagagagagagagcuucacaaacagggaaaaugugccacguguguuuauaacaugauggggaagagagagaaaaaguuaggagaguuuggaaaggcaaaaggaagucgugcaauaugguacaugugguugggagcacgcuuucuagaguucgaagcucuuggauucaugaacgaagaccacugguucagcagagagaauucacucaguggaguggaaggagaaggacuccacaaacuuggauacauacucagagacauaucaaagauuccagggggaaacauguaugcagaugacacagccggaugggauacaaggauaacagaggaugaccuucagaaugaggccaaaauuacugacauuauggaacccgaacaugcccuacuggcuaaggcaaucuucaagcuaaccuaccaaaauaaaguggugaggguacagagaccagcaaaaaauggaaccgugauggaugucauauccagacgugaccagagaggaaguggccaggucggaacuuauggcuuaaacacuuucaccaacauggaagcccaguugauaagacaaauggagucugagggaaucuuuucacccagugaauuagagaccccaaauuuagccgagagaguucuagacuggcugggaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugaucaugaaggaugggagggaaauaguggugccaugccgcaaccaagaugaacuuguggguagggcuagaguaucacaaggugcuggguggagccugagagaaaccgcaugccuaggcaaaucauaugcacaaauguggcagcugauguacuuccacaggagagaccugagacuagccgcuaaugccaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaauugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuggauuacaugacaucaaugaagagauucaagaacgagagugaucccgaaggggcacucugguga

SEQ ID NO: 6176 - RNA, 9879 nt, Artificial Sequence
  derived and/or modified CDS sequence (wt) from DENV-1__KT187560__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagauacaugggugaccuaugggacguguucucagacuggcgaacaccgacgggauaaacguucugucgcauuggcuccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauuaccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguuuaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuccaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuagauuaugcauggaagacaauggcuaugguauugucaaucguaucucucuuuccucuaugucuauccacgaccucucaaaaaacaacauggcuuccgguguuguuaggaucccuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaaccaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaggaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggagucacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuacuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuccagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa
